US011939583B2

(12) United States Patent
Schada Von Borzyskowski et al.

(10) Patent No.: US 11,939,583 B2
(45) Date of Patent: Mar. 26, 2024

(54) METHOD OF PRODUCING AUTOTROPHIC ORGANISMS WITH ALTERED PHOTORESPIRATION AND IMPROVED CO$_2$ FIXATION

(71) Applicant: Max-Planck-Gesellschaft zur Förderung der Wissenschaften e.V., Munich (DE)

(72) Inventors: Lennart Schada Von Borzyskowski, Marburg (DE); Tobias Jürgen Erb, Marburg (DE); Jan Zarzycki, Marburg (DE)

(73) Assignee: Max-Planck-Gesellschaft zur Förderung der Wissenschaften e.V., Munich (DE)

( * ) Notice: Subject to any disclaimer, the term of this patent is extended or adjusted under 35 U.S.C. 154(b) by 314 days.

(21) Appl. No.: 17/047,974

(22) PCT Filed: Apr. 15, 2019

(86) PCT No.: PCT/EP2019/059715
§ 371 (c)(1),
(2) Date: Oct. 15, 2020

(87) PCT Pub. No.: WO2019/201880
PCT Pub. Date: Oct. 24, 2019

(65) Prior Publication Data
US 2021/0163956 A1 Jun. 3, 2021

(30) Foreign Application Priority Data

Apr. 15, 2018 (EP) .................................... 18167406

(51) Int. Cl.
| | | |
|---|---|---|
| *C12N 15/52* | (2006.01) | |
| *C12N 1/21* | (2006.01) | |
| *C12N 9/04* | (2006.01) | |
| *C12N 9/06* | (2006.01) | |
| *C12N 9/10* | (2006.01) | |
| *C12N 9/16* | (2006.01) | |
| *C12N 9/88* | (2006.01) | |
| *C12N 15/74* | (2006.01) | |

(52) U.S. Cl.
CPC .......... *C12N 15/52* (2013.01); *C12N 9/0006* (2013.01); *C12N 9/0022* (2013.01); *C12N 9/1096* (2013.01); *C12N 9/16* (2013.01); *C12N 9/88* (2013.01); *C12N 15/74* (2013.01); *C12Y 101/01026* (2013.01); *C12Y 104/03016* (2013.01); *C12Y 206/01001* (2013.01); *C12Y 301/03018* (2013.01); *C12Y 401/03014* (2013.01); *C12Y 403/0102* (2013.01)

(58) Field of Classification Search
None
See application file for complete search history.

(56) References Cited

FOREIGN PATENT DOCUMENTS

| WO | WO-2003/100066 A1 | 12/2003 | | |
|---|---|---|---|---|
| WO | WO-2009/103782 A1 | 8/2009 | | |
| WO | WO-2011099006 A2 | * 8/2011 | ............. | C12N 15/70 |
| WO | WO-2015/120343 A2 | 8/2015 | | |
| WO | WO-2016/207219 A1 | 12/2016 | | |

OTHER PUBLICATIONS

Hodges, M. (2022), Photorespiration and Improving Photosynthesis. In: Progress in Botany. Springer, Berlin, Heidelberg, doi.org/10.1007/124_2022_64. (Year: 2022).*
Borzyskowski et al., Marine Proteobacteria metabolize glycolate via the β-hydroxyaspartate cycle, Nature 575, 2019, 500. (Year: 2019).*
Roell et al., A synthetic C4 shuttle via the β-hydroxyaspartate cycle in C3 plants, Proc. Natl. Acad. Sci. USA 118, 2021, e2022307118. (Year: 2021).*
Adams et al., "PHENIX: A Comprehensive Python-Based System for Macromolecular Structure Solution, Acta. Crystallogr D Biol Crystallorg," 66(2):213-221 (2010).
Ahrné et al., "Critical assessment of proteome-wide label-free absolute abundance estimation strategies," Proteomics, 13(17):2567-2578 (2013).
Allen et al., "Growth and division of Some Unicellular Blue-Green Algae," J. Gen. Microbiol., 51(2):199-202 (1968).
Berg, "Ecological Aspects of the Distribution of Different Autotrophic CO2 Fixation Pathways," Appl. Environ. Microbiol., 77(6):1925-1936 (2011).
Claassens, "A Warm Welcome for Alternative CO$_2$ Fixation Pathways in Microbial Biotechnology," Microbial Biotechnology, 10(1):31-34 (2016).
Cox et al., "The autotrophic growth of Micrococcus denitrificans on Methanol," Biochem. J., 150(3):569-571 (1975).
Emsley et al., "Coot: Model-Building Tools for Molecular Graphics," Acta Crystallogr D Biol Crystallogr, 60(12):2126-2132 (2004).
Gallagher et al., "Structure of Alanine Dehydrogenase from Archaeogloubs: Active Site Analysis and Relation to Bacterial Cyclodeaminases and Mammalian mu crystallin," J. Mol. Biol., 342(1):119-130 (2004).
Gibbs et al., "Purification and properties of erythro-β-hydroxyasparate dehydratase from Micrococcus denitrificans ," Biochem. J., 97(2):547-554 (1965).
Gibson et al., "Enzymatic Assembly of DNA Molecules up to Several Hundred Kilobases," Nat Methods, 6(5):343-345 (2009).
Glatter et a., "Comparison of Different Sample Preparation Protocols Reveals Lysis Buffer-Specific Extraction Biases in Gram-Negative Bacteria and Human Cells," J. Proteome Res., 14(11):4472-4485 (2015).
Hoelsch et al., "Engineering of formate dehydrogenase: synergistic effect of mutations affecting cofactor specificity and chemical stability," Appl. Microbiol. Biotechnol., 97:2473-2481 (2013).

(Continued)

Primary Examiner — Todd M Epstein
(74) Attorney, Agent, or Firm — MARSHALL, GERSTEIN & BORUN LLP

(57) ABSTRACT

The present invention relates to autotrophic microorganisms with altered photorespiration and improved CO$_2$ fixation as well as a method of producing said autotrophic microorganisms. Particularly, the autotrophic microorganisms show an improved growth rate, productivity and energy conversion efficiency.

16 Claims, 89 Drawing Sheets

Specification includes a Sequence Listing.

(56) References Cited

OTHER PUBLICATIONS

International Preliminary Report on Patentability for Application No. PCT/EP2019/059715, dated Oct. 20, 2020.
International Search Report and Written Opinion for Application No. PCT/EP2019/059715, dated Jul. 4, 2019.
Kabsch, "XDS," Acta Crystallogr B. Crystallogr, 66(2):125-132 (2010).
Keller et at., "Exploiting microbial hyperthermophilicity to produce an industrial chemical, using hydrogen and carbon dioxide," Proc. Natl. Acad. Sci. USA 110(15):5840-5845 (2013).
Ledermann et al., "Versatile Vectors for Efficient Mutagenesis of Bradyrhizobium diazoefficiens and Other Alphaproteobacteria," Appl. Environ. Microbiol., 82(9):2791-2799 (2016).
Markley et al., "Synthetic Biology Toolbox for Controlling Gene Expression in the Cyanobacterium Ssnechococcus sp. strain PCC 7002," ACS Synth Biol, 4(5):595-603 (2015).
Mattozzi et al., Expression of the Sub-Pathways of the Chloroflexus aurantiacus 3-Hydroxypropionate Carbon Fixation Bicycle in E. coli Toward Horizontal Transfer of Autotrophic Growth, Metab. Eng., 16:130-139 (2013).
Niederholtmeyer et al., "Engineering Cyanobacteria to Synthesize and Export Hydrophilic Products," Appl Environ Microbiol, 76(11):3462-3466 (2010).
Schwanhäusser et al., "Global quantification of mammalian gene expression control," Nature, 473:337-342 (2011).
Shinoda et al., "A Highly Specific Glyoxylate Reductase Derived From a Formate Dehydrogenase," Biochemical and Biophysical Research Communications, 355(3):782-787 (2007).
Tanaka et al., "Autotrophic Growth of Paracoccus denitrificans in Aerobic Condition and the Accumlation of Biodegradable Plastics from $CO_2$," Enviornment and Ecology Research, 4(4):231-236 (2016).
Thoma et al., "An improved Escherichia coli donor strain for diparental mating," FEMS Microbiol. Lett., 294(2):127-132 (2009).
Uhl et al., "The Crystal Structure of D-Threonine Aldolase from Alcaligense xylosoxidans Provides Insight into a Metal Ion Assisted PLP-Dependent Mechanism," PLoS One, 10(4):1-15 (2015).
Waterhouse et al., "Swiss-Model: Homology Modelling of Protein Structures and Complexes," Nucleic Acids Res., 46(W1):W296-W303 (2018).
Winn et al., "Overview of the CCP4 Suite and Current Developments," Acta Crystallogr D. Biol. Crystallogr, 67(4):235-242 (2011).
Zhu et al., "Improving Photosynthetic Efficiency for Greater Yield" Annu. Rev. Plant Biol., 61:235 (2010).

* cited by examiner

FIG. 12A

| SEQ ID No | Sequence |
|---|---|
| 1 | ATGCTCGTCGTCGCCGAAAAGGAAATCGCGGGTCTGATGACCCCCGAGGCGGCCTTCGAGGCCAT CGAGGCGGTCTTCGCCTCGATGGCCCGGCGCAAGGCATACAATTTTCCCGTGGTGCGCGAGGCCA TCGGCCATGAGGACGCGCTCTACGGCTTCAAGGGCGGCTTCGACGCCTCGGCGCTGGTGCTGGGG CTGAAGGCCGGCGGCTACTGGCCCAACAACCAGAAGCACAACCTGATCAACCACCAGTCCACCGTG TTCCTGTTCGACCCGGATACCGGCCGGGTCTCGGCGGCGGTAGGCGGCAACCTGCTGACGGCGCT GCGCACCGCGGCGGCCTCGGCGGTGTCGATCAAGTATCTGGCGCCCAAGGGCGCCAAGGTGCTG GGCATGATCGGCGCCGGCCACCAGTCCGCGTTCCAGATGCGGGCGGCGGCCAATGTGCATCGGTT CGAAAAGGTCATCGGCTGGAACCCGCATCCCGAGATGCTGTCGCGCCTTGCCGATACCGCGGCCG AGCTGGGCCTGCCCTTCGAGGCGGTCGAACTGGACCGGCTTGGGGCCGAGGCCGACGTGATCGTC TCGATCACCTCGTCCTTCTCGCCTCTGCTGATGAACGAGCATGTCAAGGGCCCGACGCATATCGCG GCCATGGGCACCGACACCAAGGGCAAGCAAGAGCTGGATCCGGCGCTGGTCGCGCGCGCACGGA TCTTCACCGACGAGGTCGCGCAGTCGGTCAGCATCGGCGAATGCCAGCACGCCATCGCGGCGGGT CTGATCCGCGAGGATCAGGTCGGCGAGCTTGGCGCGGTGGTCGCGGGCGACGACCCGGGCCGCG GGGATGCCGAGGTCACGATCTTCGACGGCACCGGCGTCGGGTTGCAGGACCTGGCGGTCGCGCAA GCGGTCGTCGAACTCGCCAAACACAAGGGGGTGGCGCAAGAGGTCGAGATCTGA |
| 2 | MLVVAEKEIAGLMTPEAAFEAIEAVFASMARRKAYNFPVVREAIGHEDALYGFKGGFDASALVLGLKAGG YWPNNQKHNLINHQSTVFLFDPDTGRVSAAVGGNLLTALRTAAASAVSIKYLAPKGAKVLGMIGAGHQSA FQMRAAANVHRFEKVIGWNPHPEMLSRLADTAAELGLPFEAVELDRLGAEADVIVSITSSFSPLLMNEHV KGPTHIAAMGTDTKGKQELDPALVARARIFTDEVAQSVSIGECQHAIAAGLIREDQVGELGAVVAGDDPG RGDAEVTIFDGTGVGLQDLAVAQAVVELAKHKGVAQEVEI |
| 3 | ATGAACGCGAAAACGGATTTCTCCGGCTACGAGGTCGGCTATGACATCCCCGCCCTGCCCGGCATG GACGAGAGCGAGATCCAGACGCCTTGCCTGATCCTCGACCTGGACGCGCTGGAGCGCAACATCAG GAAGATGGGCGACTACGCCAAGGCCCACGGCATGCGCCACCGCAGCCACGGCAAGATGCACAAGT CGGTCGACGTGCAGAAGCTGCAGGAGTCGCTGGGCGGCTCGGTCGGCGTCTGCTGCCAGAAGGTC AGCGAGGCCGAGGCCTTTGCCCGCGGCGGCATCAAGGACGTGCTGGTCACCAACGAGGTGCGCGA GCCGGCCAAGATCGACCGCCTGGCCCGGCTGCCCAAGACCGGCGCCACGGTGACGGTCTGCGTC GACGACGTGCAGAACATCGCCGACCTGTCGGCCGCCGCGCAGAAGCACGGCACCGAGCTGGGCAT CTTCGTCGAGATCGATTGCGGCGCCGGCCGCTGCGGCGTGACCACCAAGGAAGCCGTGGTCGAGA TCGCCAAGGCCGCCGCGGCTGCCCGAACCTGACCTTCAAGGGCATCCAGGCCTATCAGGGCGCG ATGCAGCACATGGACAGCTTCGAGGACCGCAAGGCCAAGCTGGACGCCGCCATTGCCCAGGTGAA AGAGGCCGTGGACGCGCTGGAGGCCGAGGGCCTGGCCCCCGAATTCGTCTCGGGCGGCGGCACG GGTTCCTATTATTTCGAAAGCAATTCTGGTATTTACAACGAATTGCAATGCGGCTCCTATGCCTTCAT GGATGCCGATTACGGCCGCATCCACGATGCCGAGGGCAAGCGCATCGACCAGGGCGAATGGGAAA ACGCGCTGTTCATCCTGACCTCGGTCATGTCGCATGCCAAGCCGCACCTGGCGGTGGTCGATGCCG GCCTCAAGGCACAGTCGGTCGATAGCGGCCTGCCCTTCGTCTATGGCCGCGACGATGTGAAATACA TCAAGTGCAGCGACGAGCATGGCGTGGTCGAGGACAAGGACGGCGTGCTCAAGGTCAACGACAAG CTGCGGCTGGTGCCGGGCCATTGCGACCCGACCTGCAACGTCCACGACTGGTATGTCGGCGTGCG GAACGGCAAGGTCGAGACGGTCTGGCCGGTCTCGGCGCGCGGAAAGGGCTACTGA |
| 4 | MNAKTDFSGYEVGYDIPALPGMDESEIQTPCLILDLDALERNIRKMGDYAKAHGMRHRSHGKMHKSVDV QKLQESLGGSVGVCCQKVSEAEAFARGGIKDVLVTNEVREPAKIDRLARLPKTGATVTVCVDDVQNIADL SAAAQKHGTELGIFVEIDCGAGRCGVTTKEAVVEIAKAAAAAPNLTFKGIQAYQGAMQHMDSFEDRKAKL DAAIAQVKEAVDALEAEGLAPEFVSGGGTGSYYFESNSGIYNELQCGSYAFMDADYGRIHDAEGKRIDQ GEWENALFILTSVMSHAKPHLAVVDAGLKAQSVDSGLPFVYGRDDVKYIKCSDEHGVVEDKDGVLKVND KLRLVPGHCDPTCNVHDWYVGVRNGKVETVWPVSARGKGY |
| 5 | ATGTATATCCCGACCTATGAGGACATGCTGGCCGCGCATGAGCGGATCAAGCCGCATATCCGCCGC ACGCCGATCCGCACCTCGGACTATCTGAACGAGTTGACCGGCGCGCAGCTGTTCTTCAAATGCGAG AACTTCCAGGAGCCGGGGGCCTTCAAGGTCCGCGGCGCCACCAACGCGGTCTTCGGCCTCGACGA TGCGCAGGCGGCCAAGGGCGTCGCGACGCACAGCTCGGGCAACCATGCCTCGTGCCTCAGCTACG CCGCCATGCTGCGCGGCATTCCCTGCAACGTGGTCATGCCGCGCACCGCCGCCAGGCCAAGAAG GACACGGTGCGCCGCTATGGCGGTGTCATCACCGAATGCGAGCCCTCGACCAGCTCGCGCGAAGA GACCTTCGCCAAGGTGCAGGCCGAGACCGGCGGCGATTTCGTCCACCCCTATAACGACCCGCGCG TGATCGCCGGCCAGGGCACCTGCGCCAAGGAACTGGTCGAGCAGGTGGACGGGCTCGACGCGGT CGTGGCCCCCATCGGCGGCGGCGGCATGATCTCGGGCACCTGCCTGACGCTCTCGACGCTGGCGC CCGAGACCAGGGTGATCGCGGCCGAGCCCGAGCAGGCCGACGACGCCTATCGCAGCTTCAAGGCC GGCTACATCATCGCCGACGACGCGCCCAAGACCGTCGCCGACGGGCTGCTGGTGCCGCTGAAGGA TCTGACCTGGCATTTCGTCAAGAACCACGTCAGCGAGATCTACACCGCCTCGGACGCCGAGATCGT GGACGCGATGAAGCTGATCTGGAAGCATCTGCGCATCGTGATGGAGCCCTCCAGCGCCGTGCCGC TGGCCACCATCCTGAAGAACCCCGAAGCCTTTGCCGGCAAGCGCGTCGGCGTCATCGTCACCGGC GGCAATGTCGATCTCGACAAGCTGCCGTGGAACTGA |

FIG. 12B

| 6 | MYIPTYEDMLAAHERIKPHIRRTPIRTSDYLNELTGAQLFFKCENFQEPGAFKVRGATNAVFGLDDAQAAK GVATHSSGNHASCLSYAAMLRGIPCNVVMPRTAPQAKKDTVRRYGGVITECEPSTSSREETFAKVQAET GGDFVHPYNDPRVIAGQGTCAKELVEQVDGLDAVVAPIGGGGMISGTCLTLSTLAPETRVIAAEPEQADD AYRSFKAGYIIADDAPKTVADGLLVPLKDLTWHFVKNHVSEIYTASDAEIVDAMKLIWKHLRIVMEPSSAVP LATILKNPEAFAGKRVGVIVTGGNVDLDKLPWN |
| --- | --- |
| 7 | ATGACCAGCCAGAACCCGATCTTCATTCCCGGCCCGACCAACATCCCCGAGGAGATGCGCAAGGCC GTCGACATGCCCACCATCGACCACCGCTCGCCGGTGTTCGGGCGTATGCTGCACCCGGCGCTCGA GGGCGTGAAGAAAGTCCTCAAGACCACGCAGGCGCAGGTCTTCCTGTTCCCCTCGACCGGCACCG GCGGCTGGGAAACGGCGATCACCAACACGCTGTCGCCCGGCGACAAGGTGCTGGCAGCCCGTAAC GGCATGTTCAGCCATCGCTGGATCGACATGTGCCAGCGCCACGGCCTTGACGTGACCTTCGTCGAG ACCCCCTGGGGCGAGGGCGTCCCGGCCGACCGCTTCGAAGAGATCCTGACCGCCGACAAGGGCC ACGAGATCCGCGTCGTCCTGGCCACGCATAACGAGACCGCGACCGGGGTCAAATCGGACATCGCC GCCGTCCGCCGCGCGCTGGACGCCGCGAAACACCCGGCGCTGCTGTTCGTGGACGGGGTCTCCTC CATCGGTTCGATGGATTTCCGCATGGACGAATGGGGCGTCGACATCGCCGTCACCGGGTCGCAAAA GGGCTTCATGTTGCCGCCGGGCCTGGCCATCGTCGGCTTCTCGCCCAAGGCGATGGAGGCGGTCG AGACCGCGCGCCTGCCGCGCACCTTCTTCGACATCCGCGACATGGCGACCGGCTATGCCCGCAAC GGCTATCCCTATACGCCGCCGGTCGGGCTGATCAACGGCCTGAACGCCAGCTGCGAGCGCATCCT GGCCGAGGGGCTGGAGAATGTCTTTGCCCGCCACCACCGCATCGCCAGCGGCGTGCGCGCCGCG GTCGATGCCTGGGGGCTGAAGCTCTGCGCCGTCCGCCCCGAGCTTTACTCGGACAGCGTCAGCGC CATCCGCGTGCCCGAGGGCTTCGACGCCAACCTGATCGTCAGCCACGCGCTGGAGACCTATGACAT GGCCTTCGGCACCGGCCTGGGCCAGGTCGCGGGCAAGGTGTTCCGCATCGGCCACCTGGGCAGC CTGACCGACGCCATGGCGCTGTCCGGCATCGCCACCGCCGAGATGGTGATGGCCGATCTGGGCCT GCCGATCCAGCTGGGCTCGGGCGTCGCCGCCGCGCAGGAACATTACCGCCAGACCACTGCCGCCG CGCAGAAGAAAGCCGCCTGA |
| 8 | MTSQNPIFIPGPTNIPEEMRKAVDMPTIDHRSPVFGRMLHPALEGVKKVLKTTQAQVFLFPSTGTGGWET AITNTLSPGDKVLAARNGMFSHRWIDMCQRHGLDVTFVETPWGEGVPADRFEEILTADKGHEIRVVLATH NETATGVKSDIAAVRRALDAAKHPALLFVDGVSSIGSMDFRMDEWGVDIAVTGSQKGFMLPPGLAIVGFS PKAMEAVETARLPRTFFDIRDMATGYARNGYPYTPPVGLINGLNASCERILAEGLENVFARHHRIASGVRA AVDAWGLKLCAVRPELYSDSVSAIRVPEGFDANLIVSHALETYDMAFGTGLGQVAGKVFRIGHLGSLTDA MALSGIATAEMVMADLGLPIQLGSGVAAAQEHYRQTTAAAQKKAA |
| 9 | ATGTCGGTTCAAATCCGCAAAAGGGGCCGTCCGAGGGGACGTGCCGGCGGCCTTGGCGCCGAGGA TTCGGGCGGCATCCGGGCGCTGGACCGGGCGCTGGACATCCTTGACCTGATCGCGGTCTCCAGCG GGTTGACCCTGACCGAGATCGCGCAGCGGCTGGACATGGCGCCTTCGACCGTGCACCGGGTGCTG GTGACGCTGGCGGCGCGCGGGGTGGCGGAAAGCGACAGCCAGACGCAGGCATGGCATGTCGGGC CGACGGCGTTCCGGCACGGCTCGGCCTTCATGCGCCGCTCGGGCCTGGTCGAGCGGGCGCGGCC GCTTCTGCGCCGGCTGATGGAGGTGACGGGCGAGACGGCGAACCTGGGCATCCTGAACGGCGATG CGGTCCTGTTCCTAAGCCAGGCCGAGACGCATGAGACGATCCGCGCCTTCTTTCCGCCCGGCACGC GCTCGGCGCTGCATGCCTCGGGGATCGGCAAGGCGTTGCTGGCCCATGCCCGGCCCCTGGACCTG AAGCGGATGCTGCGCGAGATGCGGCTGGAGCGGTTCACCGACATGACCCTGACCGATCCCGCAGC ACTGGTCGAGGATCTCGTGCAGATCCGCGCCCGCGGCTATGCGCTGGACAACGAGGAGCGCACGC CCGGCATGCGCTGCATCGCCGCGCCGATCTTCGACCTTGCCGGCGAGGCGGCGGCGGGGATCTC GGTTTCGGGGCCGACATTGCGCATGTCGGATGCCCGGCTTTCCGCCATGTCCGATGCGGTGATCGA GGCCGCGCGGGAGCTGTCCTTCGGCATGGCGCCGCGCAAGGATGCCGGCGAAAGAGCCTGA |
| 10 | MSVQIRKRGRPRGRAGGLGAEDSGGIRALDRALDILDLIAVSSGLTLTEIAQRLDMAPSTVHRVLVTLAAR GVAESDSQTQAWHVGPTAFRHGSAFMRRSGLVERARPLLRRLMEVTGETANLGILNGDAVLFLSQAETH ETIRAFFPPGTRSALHASGIGKALLAHARPLDLKRMLREMRLERFTDMTLTDPAALVEDLVQIRARGYALD NEERTPGMRCIAAPIFDLAGEAAAGISVSGPTLRMSDARLSAMSDAVIEAARELSFGMAPRKDAGERA |
| 43 | AGATCTATGCTAGTGGTGGCCGAAAAGGAGATTGCCGGTCTAATGACGCCCGAGGCGGCCTTTGAA GCGATTGAAGCGGTTTTTGCTTCGATGGCGCGTCGCAAAGCGTACAACTTCCCTGTAGTCCGGGAA GCTATCGGGCATGAAGACGCGCTTTACGGGTTTAAAGGTGGGTTTGATGCCTCTGCGTTAGTTCTCG GACTAAAAGCGGGTGGTTATTGGCCCAATAATCAGAAGCACAACCTCATTAACCACCAATCAACCGT CTTTTTATTCGACCCCGACACCGGCCGCGTCAGTGCCGCGGTTGGAGGCAACCTACTGACGGCGTT GCGTACGGCTGCGGCAAGCGCCGTTTCGATTAAATATTTAGCACCCAAGGGGCAAAGGTTCTGGG GATGATTGGTGCGGGCCATCAATCCGCATTCCAAATGAGAGCGGCAGCGAATGTGCACAGGTTCGA GAAAGTCATTGGTTGGAACCCGCATCCGGAAATGTTGTCCCGCCTGGCTGACACAGCTGCGGAGCT CGGCCTGCCCTTTGAAGCAGTTGAACTCGACCGCCTCGGAGCTGAAGCGGACGTGATTGTTAGCAT TACGAGTTCGTTCAGCCCACTGCTAATGAATGAACATGTGAAGGGCCCGACGCATATTGCCGCCATG GGTACAGACACCAAAGGGAAGCAAGAGTTAGATCCGGCTCTTGTTGCTCGTGCTCGCATTTTTACTG ACGAAGTAGCCCAAAGCGTGTCCATCGGCGAATGTCAGCATGCTATTGCCGCTGGCTTAATTCGGG AGGATCAAGTGGGTGAATTGGGCGCTGTCGTGGCCGGCGATGATCAGGCCGCGGCGATGCCGAA GTGACAATCTTCGATGGCACAGGCGTGGGACTTCAGGACTTGGCAGTGGCTCAGGCCGTGGTCGAA |

FIG. 12C

| | |
|---|---|
| | TTGGCCAAACATAAAGGGGTCGCTCAGGAGGTCGAAATCTAGCCCGTGCCGCTCGCGTCCTGAACAGGATCCTAACTCGAG |
| 44 | AGATCTACCAGAATTGAGGAGAGCCCCATGAATGCGAAAACAGACTTCAGTGGCTACGAGGTCGGCTATGATATTCCCGCTCTCCCAGGAATGGATGAGTCTGAGATCCAGACTCCTTGTCTTATCCTGGACCTTGACGCGTTGGAGAGAAACATTCGCAAGATGGGGGACTATGCTAAGGCCCACGGAATGCGACACCGTTCGCACGGTAAGATGCATAAGTCTGTCGACGTGCAGAAACTCCAGGAAAGCCTTGGGGGTAGCGTGGGGGTCTGTTGCCAAAAGGTTTCGGAAGCCGAGGCCTTTGCCCGAGGCGGTATTAAGGACGTTCTGGTAACGAACGAAGTACGTGAACCGGCCAAGATTGATCGGTTGGCAAGACTACCTAAGACTGGTGCTACGGTTACTGTGTGCGTCGACGACGTGCAAAACATTGCTGACCTCTCGGCTGCGGCTCAGAAACACGGAACGGAGTTGGGTATCTTTGTTGAGATCGACTGCGGCGCCGGACGCTGCGGAGTTACCACGAAGGAGGCGGTCGTCGAGATCGCGAAGGCCGCTGCGGCTGCGCCCAACCTGACCTTCAAAGGTATTCAGGCTTACCAAGGCGCAATGCAACACATGGATTCATTTGAAGATCGCAAAGCAAAATTAGACGCCGCAATCGCGCAGGTCAAGGAGGCCGTCGATGCCCTAGAGGCCGAAGGGCTCGCCCCAGAATTTGTTTCGGGCGGGGGCACCGGGTCATATTACTTTGAATCGAACTCCGGCATTTATAACGAATTACAGTGCGGGAGTTACGCTTTCATGGACGCTGATTACGGGCGCATCCATGATGCGGAAGGCAAACGCATCGATCAGGGAGAATGGGAAAACGCGCTCTTTATCCTGACTAGCGTTATGAGTCATGCAAAACCGCATCTAGCGGTAGTTGATGCAGGCCTGAAGGCACAAAGTGTTGATAGCGGTCTGCCGTTCGTGTATGGCCGTGATGACGTTAAATATATCAAATGCAGCGATGAACATGGCGTCGTGGAAGATAAGGATGGTGTGTTGAAAGTCAATGATAAACTGAGGCTGGTGCCGGGTCACTGTGATCCCACCTGTAATGTCCACGATTGGTATGTGGGAGTCCGCAATGGCAAAGTGGAAACCGTGTGGCCCGTGTCCGCCCGCGGCAAGGGTTACTAGGGATCCTAACTCGAG |
| 45 | AGATCTGGATGAAGGACGCCATGTACATTCCGACCTATGAGGACATGCTTGCGGCTCATGAACGCATTAAACCGCATATCCGACGCACGCCCATTCGCACGAGTGATTACCTCAACGAGTTGACCGGTGCCCAACTGTTCTTTAAGTGCGAAAATTTTCAGGAGCCTGGCGCTTTTAAAGTGCGGGGGGCCACGAACGCCGTATTTGGCCTCGACGACGCGCAAGCAGCTAAGGGAGTAGCTACACATAGTTCGGGGAATCATGCTTCCTGCCTGTCTTACGCTGCAATGTTACGAGGAATCCCCTGTAACGTCGTTATGCCCCGCACAGCCCCACAGGCAAAAAAGACACAGTTCGCAGATACGGTGGTGTGATTACTGAGTGTGAGCCTAGCACCTCTAGCCGCGAGGAAACCTTCGCCAAGGTCCAGGCTGAAACTGGCGGTGACTTCGTACACCCCTACAATGACCCTAGGGTAATTGCTGGACAGGGGACTTGTGCTAAAGAATTGGTTGAACAAGTCGATGGCCTAGATGCCGTGGTGGCGCCTATCGGCGGCGGGGGATGATTTCGGGGACTTGTTTAACGCTTTCTACATTAGCCCCTGAAACCCGTGTTATTGCGGCAGAACCGGAACAAGCGGATGATGCGTATCGTAGTTTTAAGGCAGGTTACATCATTGCTGATGACGCCCCAAGACGGTGGCGGATGGCTTGCTGGTTCCACTGAAGGATCTTACTTGGCACTTCGTCAAGAATCACGTCAGCGAAATCTATACCGCCTCAGATGCCGAAATCGTGGATGCCATGAAGCTGATCTGGAAGCACCTGCGGATCGTGATGGAACCCAGCTCCGCCGTTCCGCTGGCCACCATCCTCAAAAACCCAGAAGCGTTTGCCGGTAAACGGGTGGGCGTCATCGTCACCGGCGGCAATGTCGATCTCGATAAATTGCCGTGGAACTAGACCAGAATTGAGGAGAGCCCCGGATCCTAACTCGAG |
| 46 | AGATCTGCTTGGTCCACAAGCGCAGGAGGAATTGCCATGACCTCCCAAAATCCAATTTTTATTCCAGGCCCAACGAATATTCCCGAGGAAATGCGAAAAGCAGTGGATATGCCCACCATTGATCACAGATCCCCCGTCTTCGGCCGAATGTTACACCCTGCTCTAGAAGGGGTGAAAAAAGTCCTAAAGACTACTCAAGCACAGGTATTCCTTTTTCCTAGCACGGGGACGGGGGGTGGGAGACTGCCATCACAAACACATTGAGCCCAGGAGATAAAGTCTTAGCGGCTCGAAACGGTATGTTTTCTCACCGTTGGATCGATATGTGCCAGCGTCACGGCCTTGATGTCACATTCGTAGAGACCCCTTGGGGTGAGGGTGTTCCGCCGATCGCTTTGAAGAGATCCTGACCGCAGACAAAGGGCATGAAATCCGCGTGGTCCTCGCTACACACAACGAGACTGCGACGGGTGTGAAGTCGGATATTGCGGCAGTCCGGCGGGCTCTGGACGCAGCAAAACACCCGGCTCTGCTGTTCGTTGACGGAGTCTCAAGTATTGGCAGTATGGATTTTCGCATGGACGAGTGGGGCGTTGACATCGCAGTCACTGGCAGCCAAAAAGGTTTTATGCTCCCGCCTGGTCTCGCTATCGTGGGGTTTAGCCCCAAGGCAATGGAGGCGGTTGAGACGGCCCGTCTACCGCGTACCTTTTTCGACATCCGGGACATGGCTACCGGCTACGCTCGCAACGGATATCCGTACACCCCGCCCGTGGGACTGATCAATGGACTCAACGCATCGTGCGAACGCATCTTGGCGGAAGGGTTGGAAAATGTTTTCGCGCCATCATCGCATTGCTAGTGGCGTTCGCGCGGCGGTGGATGCGTGGGTCTGAAGCTCTGTGCTGTCCGGCGGAACTGTATAGTGATTCTGTCTCAGCTATCCGCGTCCCCGAAGGTTTCGATGCTAATCTCATCGTGAGCCATGCGCTCGAAACCTACGATATGGCGTTCGGCACCGGCTTGGGCCAAGTGGCGGGTAAGGTGTTTCGGATTGGCCATTTGGGCAGCCTGACGGATGCGATGGCCCTGTCGGGCATTGCCACGGCCGAAATGGTTATGGCCGATCTGGGCTTGCCGATTCAACTGGGCTCGGGCGTGGCCGCCGCCCAGGAACATTATCGCCAGACCACGGCCGCCGCCCAGAAGAAGGCCGCCTAGGGATGAAGGACGCCGGATCCTAACTCGAG |

FIG. 12D

| 47 | AGATCTGGCAATTCCTCCTGCGCTTGTGGACCAAGCTACGTTTTGCTGTCCATTGATGCAATTTTTCT<br>GAAAAATATTTCGCAATCGCGGAAAAATGACCTAAAGTGTCGTGGAATCAGATCGTTGCTCTTTTCCA<br>AAGCCAAAGAGTGATTTTCAACAAACTCAGAAAGTTGTCGAAAGGAAAAATTGAATGTCAGTACAGAT<br>TCGGAAGCGCGGGCGCCCACGAGGTCGTGCTGGGGGGCTCGGAGCCGAAGATTCGGGTGGTATC<br>CGGGCACTGGACCGCGCTCTGGACATTCTGGACTTGATTGCAGTGAGCAGTGGCCTGACTCTCACT<br>GAAATCGCTCAACGCCTAGATATGGCCCCTAGCACGGTCCACCGCGTGCTTGTGACTCTGGCAGCG<br>CGCGGCGTTGCGGAGAGTGACTCACAAACGCAGGCATGGCATGTGGGACCTACTGCGTTTCGACAC<br>GGCTCGGCATTCATGCGCCGCAGTGGCTTGGTTGAGAGAGCTCGCCCGTTGTTGCGCCGGCTGAT<br>GGAAGTCACGGGAGAGACGGCTAATCTCGGGATACTAAACGGCGACGCAGTATTATTCCTTTCTCAA<br>GCAGAGACACATGAGACCATTCGGGCCTTCTTTCCCCGGGCACACGCTCCGCCCTGCATGCTTCG<br>GGCATCGGTAAGGCTTTACTGGCCCACGCTAGACCGCTTGACCTCAAACGAATGTTGCGAGAAATG<br>CGGTTGGAACGCTTTACAGACATGACCCTCACCGACCCAGCCGCGTTGGTCGAGGACCTGGTTCAG<br>ATCCGCGCGCGTGGATACGCACTCGACAACGAAGAACGGACCCCCGGTATGCGTTGCATTGCGGCT<br>CCCATCTTCGATCTGGCCGGCGAAGCCGCAGCCGGCATCAGTGTCAGCGGCCCCACCCTCCGGAT<br>GTCGGATGCTCGGCTGAGCGCGATGTCAGATGCGGTTATCGAGGCTGCTCGTGAACTCTCTTTTGG<br>GATGGCACCGCGCAAAGATGCCGGGGAACGTGCATAATTCGTCTAAACTTGACCAGGACATGCCCG<br>GCTATTCAGGGGAGATTGCCGGGATTCGCGGTGATTTGTATATTAACCGCAGATTCACGTTCAGTT<br>CACGCGGCCCATCCTAGCTTCGGTGCAGCATGGATCCTAACTCGAG |
| --- | --- |
| 48 | CCACCAGGTCAACGATGAGGGACTGGTTGATCGGTCTAGTCATCAAATAAAACGAAAGGCTCAGTCG<br>AAAGACTGGGCCTTTCGTTTTATCTGTTGTTTGTCGGTCCATGGGAACGCTCTCCTGAGTAGGACAA<br>ATCCGCCGGGAGCGGATTTGAACGTTGCGAAGCAACGGCCCGGAGGGTGGCGGGCAGGACGCCC<br>GCCATAAACTGCCAGGCATCAAATTAAGCAGAAGGCCATCCTGACGGATGGCCTTTTTGCGTTTCTA<br>CTCTAGTTTCGAATTGTGAGCGCTCACAATTTCGAAACCCCAGGCTTTACACTTTATGCTTCCGGCTC<br>GTATAATGTGTGGAATTGTGAGCGGATAACAATTTCTAGAGAATTCCACACAGGAGAAGATCTCATAT<br>GGGATCCTAACTCGAGGGATC |
| 49 | GGTCCATGGGAACGCTCTCCTGAGTAGGACAAATCCGCCGGGAGCGGATTTGAACGTTGCGAAGCA<br>ACGGCCCGGAGGGTGGCGGGCAGGACGCCCGCCATAAACTGCCAGGCATCAAATTAAGCAGAAGG<br>CCATCCTGACGGATGGCCTTTTTGCGTTTCTACTCTATTAACAAAAAAGCAGGAATAAAATTAACATG<br>ATGTAACAGACATAAGTCCCATCACCGTTGTATAATGTTAACTGTGGGATTGCAAAAGTCTAGAGAAT<br>TCCACACAGGAGAAGATCTCATATGGGATCCTAACTCGAGGGATC |
| 62 | ATGAACATCTGCTTTGCCCCCTGCCCCGTGGTTTTCGATCTTGACGGCACGCTGATCGACAGCGTGC<br>CCGACATCCATGCCTGCGTGAACGCGGTCTTGCGCCTGCACGGCGTGGCTCCGCTGACGCTCGAT<br>CAGGTGCGCGGCTTCGTCGGCGGCGGCGTCGATCTGCTGTGGCGGCGGGTGATCGGCACGACCG<br>GGCTGCCGGCCGAGGCGCATCGCGACCTGGTCGCCTCGTTCATGACCCGCTATCACGACGCCACC<br>GGCCTGACCCGGCTTTATCCCAATGTCACCGAGGCGTTGGGGATACTGGCCGACCGCGGCTATCC<br>GCTGGGGCTCTGCACCAACAAGCCGCTGGGGCCGACGCGGGCGATCCTGGACCATTTCGGCATCG<br>CGCACCTGTTCGGCATGGTGATCGGCGGCGATTCCCTGCCCCAGCGCAAGCCCGATCCGGCGCCG<br>CTGCGCGCGGCCTTCGCCGGGCTGGGCGCCGATCCCCTGAAGCCGCGCGGGGTCTATGTCGGCG<br>ACAGCGAATTCGACGAGGAATGCGCCAGCAATACCGGCGTGCCCTTCCTGCTGTTCACCCACGGCT<br>ATCGCAAGACTCCGGTCGAGCAGATGGCGCATCATGGCACGTTCGACGATTTCGCCCACCTGCCCC<br>TGCTGGTCGAGGAGACTTCGGCCGTCGGCTAG |
| 63 | MNICFAPCPVVFDLDGTLIDSVPDIHACVNAVLRLHGVAPLTLDQVRGFVGGGVDLLWRRVIGTTGLPAEA<br>HRDLVASFMTRYHDATGLTRLYPNVTEALGILADRGYPLGLCTNKPLGPTRAILDHFGIAHLFGMVIGGDS<br>LPQRKPDPAPLRAAFAGLGADPLKPRGVYVGDSEFDEECASNTGVPFLLFTHGYRKTPVEQMAHHGTFD<br>DFAHLPLLVEETSAVG |
| 64 | TCAAAACCCAAAATCCCTCTTATTTCAAACACGTGGCGAAATCCTGTTCGTTCATAACTGGCAGTTAG<br>AGATGCAAACAGAATCAAACTGTAGGGAGTAAACTGTAAATACTTCCTTTTCAAAGTAAGTGTATTTG<br>ATGATAATGGTTCTCTGATTAGAAAAGGCTCCGGCTTTATCATTCTCAGACCATCATCACTAAGCAGT<br>AAGTAAGCACTATAATCGCAGAAGATAGATAAAATGGAAGTAGGGTTTCTGGGTTTGGGAATCATGG<br>GAAAAGCCATGTCAATGAATCTATTGAAGAATGGATTCAAAGTCACTGTATGGAACAGAACACTCTCC<br>AAGGTAATTTTTTTTTTTTTTTTGTCTTTGATTGTGTTTTGGTATTATGGTTTTCTGATTTAGTTTTAGTT<br>GTTCAGATCTGATAAAGTCGGAAACTTTTTGAGTAATTTAATGCAATTTTGGGAATTTTTGATGATTGT<br>GACAGTGTGATGAGCTTGTGGAGCATGGTGCATCAGTATGTGAGAGTCCAGCTGAAGTAATCAAGAA<br>ATGCAAATACACTATTGCTATGCTCTCTGATCCTTGTGCTGCTCTTTCGGTATTTGAAATCCTTTTTTG<br>CTTCTTTTGTGTGTGTTTTAGCATTGGTGATGAATGATATGAAGTAGTTGTTTGATTAGGTTGTTTTCG<br>ATAAAGGCGGTGTTTTGGAGCAGATATGTGAAGGAAAAGGTTATATCGATATGTCGACTGTTGATGC<br>AGAGACTTCTTTGAAGATCAATGAGGTTGAATCTTTTGTACTTTAGATGCTGATGATAAGATTAGAAGA<br>AGGTTGATTAGTTTGATTGAGCTGTGTTGCGCATTGGTAGGCAATCACCGGGAAGGGTGGTCGGTTC<br>GTAGAAGGTCCGGTTTCAGGTAGCAAAAAGCCAGCTGAAGATGGCCAACTCATTATCCTTGCTGCTG<br>GTGACAAGGTACAACTCAAAACTGTACTTATGGATTGATTGATAGATCTCAAGAACTGTTTTAGTTGG<br>ACTTAGTAGGAAGGAGCTCTCGATGTGCGGCTATAATCCGTTTGTGTTTTAATCCTTTTTTGTAAGGC |

FIG. 12E

| | |
|---|---|
| | ACTCTTTGAGGAATCAATCCCAGCTTTTGATGTCTTGGGGAAGAGATCGTTTTACTTGGGACAAGTTG GAAACGGAGCTAAAATGAAGCTAATAGTGAACATGATAATGGGAAGGTGAATGCCCGTCTCTTTTA CAATTACTACCATTAGTAGTAGGAATGGAACATGGCTTCATGATCTTATTGTTTTCGTCTGATACAGC ATGATGAATGCATTCTCTGAGGGGCTTGTATTGGCTGACAAGAGTGGACTTAGCTCTGACACTCTTTT GGATATTCTGGTGAGGTGATCAAACTTTTGCAAGCTCTGAAATAATGGTGTTGGTTTGAATCGGTTTC TGCTATGGGCAGGATCTGGGAGCAATGACTAACCCGATGTTCAAGGGGAAAGGACCTTCAATGAAC AAGAGTAGTTACCCACCAGCATTTCCATTGAAACATCAGCAGAAAGACATGAGGCTAGCTCTTGCTC TTGGCGATGAAAACGCGGTTTCCATGCCTGTAGCCGCGGCTGCAAACGAGGTCAGTTAGTTAGTTA GTTACTCAGAGACAATAACATATTGGCTCTCCCTCCTCTAGATTGGTTTCTTAGCTTGAATCTTAAAAT ATATGTTTCGGTTCTCGACAGGCTTTTAAGAAGGCGAGAAGCTTGGGACTAGGAGATCTCGACTTCT CTGCTGTGATTGAAGCTGTGAAATTCTCCCGCGAATAGCAAACTGTTTCAAAACATCCACTCATTTGG ATTGGCTGAGATACTGAAATCATTGTTATCTTCCCAAATAGAGATTTACTCATTTGGCCAAACACACAT TTTACTCCTTCACCAAATAAAAAGTCTTAACCACATATCCAGAAACGTTCATAGAGTTGCAACCTTACG TTTCAACTACTTTATGGCTAGTTCACTCGATATTGGTCCAGAGGTAGATCAAATTGATTGAAACAGAA CCAATAAAATAGAGCAAAGTTTATTTGAAGTTGGTCACTGTTAAGGTTATATGAAACAAAGGAAGCAA AAAAGAACCCGTAGATGAAGATCAAAGAAATAACATTGCATCAAGATGGTCAAGAGAA |
| 65 | MEVGFLGLGIMGKAMSMNLLKNGFKVTVWNRTLSKCDELVEHGASVCESPAEVIKKCKYTIAMLSDPCA ALSVVFDKGGVLEQICEGKGYIDMSTVDAETSLKINEAITGKGGRFVEGPVSGSKKPAEDGQLIILAAGDK ALFEESIPAFDVLGKRSFYLGQVGNGAKMKLIVNMIMGSMMNAFSEGLVLADKSGLSSDTLLDILDLGAMT NPMFKGKGPSMNKSSYPPAFPLKHQQKDMRLALALGDENAVSMPVAAAANEAFKKARSLGLGDLDFSA VIEAVKFSRE |
| 66 | MAAGTARNFPVIREAIGHADALYGFKSGFDRQALNLGLKSGGYWPGNADKGLTNHQSTVFLFDADTGRC QAVVGGNLLTALRTAAASSVSIKHLARQDAKVIGMIGAGHQAKFQLRAALEQRNFEKVIGWNLHPEMLVN LQEVADEAGLPFEAVELDGMREADVIITITSSFDAILKADQVSPGTHIACMGTDTKGKQEVDPQLLVMADV FTDEVAQSISIGEAQHAVAHGLIQAADVAQIGAVINGTNPGRTSDAQITLFDGTGVGLQDLAVAATVVERA RAAGAGTEIAF |
| 67 | MYIVPERVIADLMTREAAFDAVEKVFAAMAAEDAYNFPVVREAIGHEDALYGFKGGFDRAGLTLGLKAGG YWPHNLEKRGQINHQSTVFLFDPDTGKAHAMVGGNLLTALRTAAASSVSIKHLARDDAKVIGMIGAGHQA TFQLRAALEQRNFEKVIGWNLHPEMLPNIEAVAAEEAGLPFEAVELDGMRAADVIISITSSFEASLMADHVS PGTHIACMGTDTKGKQEVDPALLVRAEVFTDEVAQSVGIGEAQHAVAQGLIEAADLTQLGAVINGAHPGR STDDQITLFDGTGVGLQDLAVAARVVELAVTQGIAMEVDF |
| 68 | MIIVPEKEIAGLMTRADAYNAVEQVFASMSSGRAYNFPVIREAIGHADALYGFKSGFDRDGLALGLKSGGY WPGNEANGLTNHQSTVFLFDADTGKCRAIVGGNLLTALRTAAASAVSINHLARKDASVLGMIGAGHQSVF QLRAAVEQRSFDKIIGWNYHPEMLQRLAAVAAELGIPFEAVSLAQLGAEADVIISITSAFAPSLLDIHVRPGT HIACMGTDTKGKQELEAAVLARATVFTDEVAQAVTIGEAQHAIAAGLITQDAIHEMGAVVNGTHPGRTSPD EITVFDGTGVGLQDLAVASAVVDLAVAKGVATTVEF |
| 69 | MLVVAEKEIAGLMTPEAAFEAIEAVFASMARRKAYNFPVVREAIGHEDALYGFKGGFDASALVLGLKAGG YWPNNQKHNLINHQSTVFLFDPDTGRVSAAVGGNLLTALRTAAASAVSIKYLAPKGAKVLGMIGAGHQSA FQMRAAANVHRFEKVIGWNPHPEMLSRLADTAAELGLPFEAVELDRLGAEADVIVSITSSFSPLLMNEHV KGPTHIAAMGTDTKGKQELDPALVARARIFTDEVAQSVSIGECQHAIAAGLIREDQVGELGAVVAGDDPG RGDAEVTIFDGTGVGLQDLAVAQAVVELAKHKGVAQEVEI |
| 70 | MSKGLLIVGEDICAEVVSSADAFTAVEAVFGAMAKGDAYNFPVIREAIGYADALYGFKSGFDKAGKTLGVK SGGYWPGNMDKGLTNHQSTIFLFDPDTGMLEALVGGNYLTAVRTAASSSVSIAHLARKDAKVLGMVGAG HQSTFQLRAAAEQRDFEKVVAWNPHPDMLPRLGAVAEELGLAFEAVTQEELGAQADVIITITSAFEPLLM KDWIKPGTHIACMGTDTKGKQEVDPELLVSATVFADEIAQSVTIGEAQHAVASGRLSDAEITPIGAVINGTH AGRSSDQQITLFDGTGVGLQDLAVASVAAREAESRGKATRIAL |
| 71 | MIIVPEKEIGGLVTREAAFDAVESVFAAMASGDAYNFPVIREAIGHVDALYGFKGGFDKAGMSLGLKAGGY WPNNLDTKGIINHQSTVFLFDPDTGQVSAMVGGNLLTALRTAAASSVSIKHLARKDAKVLGMIGAGHQAK FQLRTALEHRDFEKVIGWNLHPEMLPNLEEVAAEAGLPFEAVELSGMTEADVIITITSSFDATMMGDHVAP GTHVACMGTDTKGKQEVGVDLIAKATLFADEIAQSISIGECQHAIADGSIKEADITPIGAVINGTHTGRMSD DEITLFDGTGVGLQDLAVASAAVVLAKAQGKAIEVEL |
| 72 | MLQKPDTDGLVIVTEEICQKVIDRDLAFAAVRDVFGAMARGDAYNFPVIREAIGHEDALYGFKSGFDKAG MVLGVKAGGYWPNNMAKGIINHQSTVFLFDPDTGKLKALVGGNYLTAIRTAASSAVSIDQLARKDAKVLG MVGAGHQSTFQLRAAVEQRDFEKVVCWNPHPDMIPNLGKVAAEIGIPFEAVSREELGAQSDVIITITSAFE PLIEAGYIKPGTHLACMGTDTKGKQEVAAELVAKATLFTDEVAQSTTIGETQHAIASGAITQDDVTPIGKVIN GDHPGRTSDDEITLFDGTGVGLQDLAVAAVAAEQAVATGAATRVSL |
| 73 | MYIVPESAIADILTRPDAFNAVEQVFAAMSAGVAYNFPVIREAIGHEEALYGFKGGFDGKGMSLGLKAGGY WPHNLEKRGIINHQSTVFLFDPDTGKVAAMVGGNLLTALRTAAASSVSIKHLARKDSKVMGMIGAGHQAK FQLRHALETHSFEKVIGWNYHPEMLPSLAEVAAEFDLPFEAVTLEGMTEADVVISMTSSFNPIFGAAHISD GTHIACMGTDTIGKQECETDLIVKATVFTDEVAQSVTLGETQHAVSAGLKSRDDIFELGAVINGTHAGRTS DREITLFDGTGVGLQDLAVAASIVEIAKAKGIGMDVDF |

FIG. 12F

| | |
|---|---|
| 74 | MYIVPEKAVADLVTREASFDAVEKVFAAMASGDAYNFPVVREAIGHEDALYGFKGGFDRAGLTLGLKAG GYWPNNLEKRGLINHQSTVFLFDPDTGKVKAMVGGNLLTALRTAAASSVSIKHLARQGAKVIGMIGAGHQ ATFQLRAALEQRPFEKVIGWNYHPEMLPNIEKVAAEAGVPFEAVDLPGMADADVIISITSAFAPSLMADHV SPGTHIACMGTDTKGKQEVEAELLVKATVFTDEVAQSISIGEAQHAVAQGLIQESDVAQIGAVINGTNPGR TSDDQITLFDGTGVGLQDLAVAASVVEVALEKGIAIEVDF |
| 75 | MYVVAEKEIAGLMNPEAAFEAIEAVFAAMARRKAYNFPVVREAIGYEDALYGFKGGFDASGLALGLKAGG YWPNNQKHGLINHQSTVFLFDPDTGRVSAAVGGNLLTALRTAAASAVSIKYLAPKGAKVLGMIGAGHQSA FQMRAAANVHGFEKVIGWNPHPEMLSRLADTAAELGLPFEAVDLPQLGEEADVIISITSSFSPLLLNEHVK GPTHIAAMGTDTKGKQELDPALVTRARIFTDEVAQSISIGECQHAIAAGLIKEEQISELGAVVTGDNPGRAD AEVTLFDGTGVGLQDLAVAQKVLEIAKEKGIAQQVEI |
| 76 | MAGFSTRKGLLMYIVAEKEIAGLMTPAAAFEAIEAVFAAMAARKAYNFPVVREAIGYEDALYGFKGGFDGA ALTLGLKAGGYWPNNQKHNLINHQSTIFLFDADTGRAKAAIGGNLLTALRTAAASAVSIKYLAPKGAKVLG MIGAGHQSAFQMKAAAAVHSFEKVIGWNPHPEMLTRLAETAAGLGLPFEAVELDRLGAEADVIISITSAFS PLLMDAHVKGETHIAAMGTDTKGKQELDPALVARARIFTDEVAQSISIGETQHAIAAHLIAEEEAVHELGAVV TGAIPGRDGAEVTLFDGTGVGLQDLAVAAKVLELAIEKGLAQQAEL |
| 77 | MIIVPENEIAGLVTPADCLKAVEGVFASMANKSAYNFPVIREAIGHADALYGFKSGFDRKGLALGLKAGGF WPNNVHKGLTNHQSTVLLFDADTGKCRAVVGGNLLTALRTAAASAISIKYLARKDAKVLGMIGAGHQATF QLRAALAQRPFEKIVGWNLHPDMLCRLEEVAKEEGLPFEAVDLDRLGAEADVIISITSSFAPMLKASQVRA GTHLACMGTDTKGKQEVEAEILAAATVFTDEVAQAITIGESQHAIERGLIREEAIVEIGAVINGTHPGRTSAD QITLFDGTGVGLQDLAVASAAVELALAKGVAIEVDF |
| 78 | MWIVPESVIADLVDEHSAFDAIEASFAAMARGDAYNFPVVREALGAGRQYGFKSGLDRVGALLGVKAGG YFPGNADRGIPNHQSTVYLFDQDSGKPTAIVGGNLLTALRTAAASAISIAHLARKDAKVLGMVGAGHQSA FQMRAAVRQRQFDRVIGWNLHPDMLSRLAETAAELGLPFEAVDLDQLGAQADVIITITSSFDAILQDAHIR PGTHLACMGTDTKGKQELDPAILTRATVFTDEVAQSISIGEAQHAVGAGILHADAIVEIGAVINGTHHGRRD AQEITVFDGTGVGLQDLAVASRAVALAIERGLAQKIDF |
| 79 | MLIVPEREIADLMTRDAAFAAVEQVFAAMAKAYNFPVVREAIGHEDALYGFKGGFDRAGLTLGLKAGG YWPNNMDKRGLINHQSTVFLFDPDTGKVRAMVGGNLLTALRTAAASSVSIRHLARKDAKVIGMIGAGHQA TFQLRAALEQRGFEKVIGWNYHPEMLPNIEKVATEAGLPFEAVDLPGMAEADVIITITSAFAPSLLAEHVSP GTHIACMGTDTKGKQEVEAALLARATVFADEIAQSVSIGEAQHAIAEGLLQEADIAQLGAVINGTHPGRKD AAEITLFDGTGVGLQDLAVAAAVVDLAVAQGRAIEVDF |
| 80 | MSEVLIVGEEICQQIVGRAEAFAAVEAVFAAMDRGEARNFPVVREALGHARALYGFKSGFDQAGHVLGV KSGGYWPGNMDRGLTNHQSTVFLFDPDTGQLSALVGGNYLTAVRTAASSAVSIAHLARRDARVLGMVG AGHQSTFQLRAAAEQRAFEKVVAWNPHPEMLPRLAVVAEELGLEFEAVSPQELGAQADVIISITSAFEPLL MSGWIRPGTHLACMGTDTRGKMEVDSALLARATVFTDEVAQSVSIGEAQHAVSQGLIGAEDITPIGAVIN GGHPGRGSEADITLFDGTGVGLQDLAVASVAAKLAVERGLGARASL |
| 81 | MLIVPERDIADLMTREAAFDAVEKVFAAMASGDAYNFPVVREAIGHEGALYGFKGGFDRADLTLGLKAGG YWPNNLEKRGLINHQSTVFLFDPDTGKPSAMVGGNLLTALRTAAASSVSIKHLARADAKVIGMIGAGHQA TFQLRAALEQRTFEKVIGWNYHPEMLPNIEKVAAEAGLPFEAVDLPGMAGADVIISITSAFAPSLMADHVS PGTHLACMGTDTRGKQEVEAGLLARATVFTDEVAQSISIGEAQHAISDGLIKESDIAQLGAVINGTHPGRT SEDQITLFDGTGVGLQDLAVAAAVVDLAVDRGIAIEVDF |
| 82 | MKSHEIIVPEAEIAGLMTPEAAFDAVEAIFGAMARKDAYNFPVIREAIGHADALYGFKSGFDRAGGALGLK SGGYWPGNEAKGLTNHQSTVILFDRDTGRPKAMVGGNLLTALRTAAASAVSIKHLARADSKVLGMIGAG HQSAFQMRAALSQRPFEKVIGWNPHPEMLSRLEAVATEAGLPFEAVDLRLGAEADVIISITSSFDAILQD AQVTAGTHVACMGTDTKGKQEVEAALVARATVFTDEIAQSTTIGEAQHAIASGLITEAAITEIGAVINGTHP GRTSAEEVTLFDGTGVGLQDLAVAEAVVDLALKTGVATRVPF |
| 83 | MIIVPEREIAGLITPEAAFDAVENVFGAMARGEALNFPVIREAIGHADALYGFKSGFDRAGLVMGLKSGGY WPGNADKGLTNHQSTVILFDPDTGRATALVGGNLLTALRTAAAAAVSIRHLARPDAKVLGMIGAGHQSTF QMRAALAQRRFERVIGWNLHPERLSRLQEVAQEHDLPFEAVDLPQMREADVIITITSSFDPILMSDHVAD GTHIASMGTDTKGKQELEPALVARARRFTDEVAQSVSIGECQHAVAAGLIGADDIAEIGAVINGTYPGREG AREVTLFDGTGVGLQDLAVAAAAVRLAGEKGVAIEVDF |
| 84 | MWIVPEGEIAGLMTPEAAFDAVEAVFAAMARGDASNFPVVREAIGHEDALYGFKGGFDGAGMTLGLKAG GYWPNNAKHGIINHQSTVFLFDPDTGRVSAAVGGNLLTALRTAAASAVSSKYLAPKGAKVLGMIGAGHQS AFQMKAAVRFGDFDRVIGWNPHPEMLTRLADTAAELGLPFEAVELDRLGADADVIISITSAFEPLLLDAHV TGPTHIAAMGTDTKGKQELDPVLVARSRLFTDEVAQSVSIGEFQHAAAQKLISEGDVIALGQVINGQHEGR GDAEVTIFDGTGVGLQDLAVAAAVVELAKQQGKAIEVAI |
| 85 | MQTQSPLLIVPEHLIADLISAQDCFAAVEQVFAAMARDTAYNFPVIREAIGHADALYGFKSGFDRESLALGL KSGGFWPRNADKGLTNHQSTIFLFDADTGRCRAVVGGNLLTALRTAAASAVSIRHLARPDARVLGMIGAG HQSTFQLRAALDQRDFDKVVGWNLNPADLDRLAKVAGERGIPFQAVDLDQLGAQADVIITITSSFAPILQA AQVRPGTHLACMGTDTKGKQEVEAALLAKASVFTDEVAQSVTIGEAQHAVAQGLIAEGDITQIGAAINGD RPGRVSDDQITLFDGTGVGLQDLAVASAAVDLAVERGIAIQVQI |

FIG. 12G

| | |
|---|---|
| 86 | MIIVPEKEIAGLLTRADAFDAVEKVFASMSKGSAYNFPVIREAIGYEDALYGFKGGFDKAGMALGLKAGGY WPNNLEKHGHINHQSTVFLFDPDTGMVKAMVGGNLLTALRTAAASSVSIKHLARKDAKVMGMVGAGHQ ATFQLRAALEQRNFEKVIGWNYHPEMLPNIEKVANEAGVPFEAVPLEGLAEADVVISITSTFAPTIMADHIA PGTHIACMGTDTKGKQEVEASLLARATVFTDEVAQSISIGEAQHAVASGLIEQSDVHELGAVINGTHPGRT SADEITLFDGTGVGLQDLAVASSIVDLAVEKGIAIIVDF |
| 87 | MIEENNINNEGLLIVSEDACKAVIDRDSAFTAVKNVFASMSRGDAYNFPVIREAIGYADALYGFKSGFDRA GKSLGLKSGGYWPGNAAKGLTNHQSTIFLFNPDNGKLRALVGGNYLTAVRTAAASAVSIAHLARKDSKVL GMVGAGHQSTFQLRAALEQRNFEKVIAWNKDADRLSILQEIAEELGIPFESVEREQLCAEADVIITITSAFE PLLMKEWIKPGTHIACMGTDTVGKQEVDAALIVSATVFTDEIAQSISIGEAQHAIKSGAITADAITTLGDVING EHPGRSSDDEITLFDGTGVGLQDLAVASAAARLAVEKGQAQHISL |
| 88 | MYIVPEAAIADILTRDAAFDAVENVFAAMSAGDAYNFPVIREAIGHEDALYGFKGGFDGKGMSLGLKAGG YWPHNLAERGLINHQSTVFLFDPDTGKVAAMVGGNLLTALRTAAASSVSIKHLARKDSKVMGMIGAGHQ AKFQLRAALETHQFEKVIGWNRNANALSTLADVAAEFDLPFEAVSLEGMVEADVVISITSVFSPIFGAAHIS DGTHVACMGTDTIGKQEADTDLVTKATVFTDEVAQSVTLGEAQHAVGAGLKSREDIHELGAVINGTHKGR TSDTEITLFDGTGVGLQDLAVSASIVEIAKAKGIGLEVDF |
| 89 | MYIVPEKAIADLVTREASFDAVEKVFAAMAAGDAYNFPVVREAIGHEDALYGFKGGFDRAGLTLGLKAGG YWPNNLEKRGLINHQSTVFLFDPDTGKVKAMVGGNLLTALRTAAASSVSIKHLARQDAKVIGMIGAGHQA TFQLRAALEQRQFEKVIGWNYHPEMLPNIEKVAAEAGLPFEAVDLPGMAEADVIISITSAFAPSLMADHVS PGTHVACMGTDTKGKQEVEAELLVKASVFTDEVAQSISIGEAQHAVAQGLIQESDVAQIGAVINGTNPGR TSDDQITLFDGTGVGLQDLAVAASVVEVAVEKGIAIEVDF |
| 90 | MLAPVDPPTNKKGISIVSEDVCQQTVGRPEAFTAVENVFAAMARGDAYNFPVVREAIGHADALYGFKSGF DRAGMSLGVKSGGYWPGNAAKGLTNHQSTIILFDPDTGQIKSIVGGNYLTAVRTAASSAVSIAHLARKDA KVLGMIGAGHQSTFQLRAAVEQRDFEKVLAWNPHPKNLVRLATVCAELGLPFEAVEREQLCAEADVIITIT SAFEPLLRHEWIKPGTHIACMGTDTKGKQEVDPALLVAATLFTDEIAQSISIGEAQHAVASGALKAGDITSL GDVINGDHCGRSSAEEITLFDGTGVGLQDLAVASVAVQLADERKLSSKISL |
| 91 | MIIVPENQIAGLMTPADCLVAVEEVFASMAKRSAYNFPVIREAIGYADALYGFKSGFDRSNLALGLKSGGF WPNNVQIGLANHQSSVFLFDADTGKCRAVVGGNLLTALRTAAASAISIKHLARKDAKVLGMIGAGHQSAF QLRAAVEQRSFEKILAWNLHPEMLSRLAEVAMELKLPFKIVDLERLGAESDVIISITSSFAPIFKASQVRPGT HLACMGTDTKGKQEMEAELVAAATVFTDEVAQAVTIGECQHAIEKKLLSRDDITELGAVITGRHPGRSSP DEITLFDGTGVALQDLAVASAAVAHAVSRGTAIEVDF |
| 92 | MLIVPEREIADLMTREAAFDAVEKVFAAMASGDAYNFPVIREAIGHEDALYGFKGGFDRAGLTLGLKAGG YWPNNLERHGLINHQSTVFLFDADTGMVKAMVGGNLLTALRTAAASSVSIKHLARRDAKVLGMVGAGHQ ATFQLRAALEQRAFEKVIGWNYHPEMLPRIEKVAAEAGVPFEAVELDGMREADVIISITSAYAASLMAKHV SPGCHVACMGTDTKGKQEVEAALLARATVFTDEIAQSVTIGEAQHAIAEGLIGESDIAQLGAVINGTLPGR TSQEQITLFDGTGVGLQDLAVAASVVALAVEKGAAIEVDF |
| 93 | MSTENKGVSIVSEKTCQAVVGRPEAFTAVENVFAAMAKNSAYNFPVVREAIGHADALYGFKSGFDRDGM VLGVKAGGYWPGNAQQGITNHQSTVILFDPDTGKIKSLVGGNYLTAVRTAASSAVSIAHLARKDSKVLGM VGAGHQSTFQLRAAVEQRDFEKVVAWNFHPDMLPNLEKVCVELGLPFEAVSREELGAQADVIITITSAFE SLMQKDWIKPGTHIACMGTDTKGKQEVDADLLAAATVFTDEVAQSISLGEAQHAIESGLIQISDITPIGEVIN GTHQGRTSEDEITLFDGTGVGLQDLAVASAAADLAEAQGKANFIDL |
| 94 | MLIVPEREIANLMTRSAAFDAVESVFAAMASKNAYNFPVIREAIGHEDALYGFKGGFDKQGMTLGLKAGG YWPNNLEKHGVINHQSTIFLFDPDTGMVKAMVGGNLLTALRTAAASSVSIKHLARKDAKVMGMVGAGHQ ATFQLRAALEQRPFEKVIGWNYHPEMLPNIEKVANEAGVPFEAVELDGMVEADVVISITSTFEPTVMAKHI SPGTHIACMGTDTKGKQEVEAALLGKATVFTDEVAQSITIGEAQHAIYNHMIRPENIVQIGEVINGTHKGRT SDDEITLFDGTGVGLQDLAVAASVVELAVKNGVAIEVDF |
| 95 | MRIVPEAIIKDHISREDSFEAVEQVFASMAARSAYNFPVIREAIGHADALYGFKSGFDRNALNLGLKSGGY WPGNSEKGLTNHQSTVFLFDADTGKCSAIVGGNLLTALRTAAAAAVSVAHLARKDAEVLGIVGAGHQASF QLRAVAEQRDFKKVVAWNRSPEKLATLEQVARELGLPFEAVSVEDLCAQSDVIVTITSSFDAIIHSDQVRP GTHIACMGTDTKGKQEVDAALVARSSVFTDEIAQSTTIGEAQHAVAIGSLSEAAIVELGAVINGAHPGRGS ADEVTLFDGTGVGLQDLAVAATVVERASKAGAAIDVF |
| 96 | MYVVPESAIADLISPQDSFEAVESVFAAMARKDAYNFPVIREAIGHADALYGFKSGFDRAGLVLGLKAGGY WPGNADKGLTNHQSSVFLFDPDTGRPTAMVGGNLLTALRTAAASAVSIRYLAPKGAKVLGMIGAGHQSA FQMRAAAKQRDFEKVIGWNFHPEMLSRLEETAAELGLPYESVDLDRMGAEADVIVSITSSFDPILKDAQV KGGTHLACMGTDTKGKQEVEAALLARARVFTDEIAQSITIGEAQHAVADGSLAESDITEIGAVIAGMDPGR RSDDEITLFDGTGVGLQDLAVAAKAVELARERGIGQEIEV |
| 97 | MIIVPEHAIDGLLTEAECFGAVEQVFASMARRRAGNFPVVREAIGHADALYGFKSGFDRDSLALGLKAGG FWPGNAAKGLTNHQSTVFLFDADTGRCRAVVGGNLLTALRTAAACAISIRHLAREGARVLGMIGAGHQS AFQLRAALVQRPFERVLAWNLHPGMFGRMEAVARERGVPFEVVDLDRLGAEADVVVTITSSFAPILKAAQ VRPGTHVACMGTDTRGKQEVEAELLAAATVFTDEVAQSVSLGEAQHAVARGLLAADSIVEIGAVINGDHP GRVSDAEITVFDGTGVGLQDLAVAAVAVDRALAKGLATEVGF |

FIG. 12H

| | |
|---|---|
| 98 | MLIVPERDIADLMTRDAAFDAVERVFAAMAAGDAYNFPVVREAIGHEEALYGFKGGFDQSGLTLGLKAGG YWPNNLEKRGIINHQSTIFLFDPDTGKVKAMIGGNLLTALRTAAASSVSIKHLARPDAKVIGMIGAGHQATF QLRAALEQRNFEKVIGWNYHPDMLPNIEKIATEAGVPFEAVELEGMRQADVIISITSAFAPSLMADHVAPG THVACMGTDTKGKQEVEAALLAKAAVFTDEVAQSITIGEAQHAVAQGLIAEADVAQLGAVINGTDAGRTS EDQITLFDGTGVGLQDLAVAAAVVDLAVEQGIAIEVDF |
| 99 | MHIVPERDIADLMTRAAAFDAVEKVFAAMAAEDAYNFPVIREALGHEEALYGFKGGFDRAGSTLGLKAGG YWPHNLEKRGLINHQSTVFLFDPDTGKVSAMVGGNLLTALRTAAASSVSIKHLAREDAKVIGMVGAGHQA TFQLRAALEQRSFEKVIGWNLHPEMLPNLEKVAAEAGLPFEAVDLPGLKEADVVITITSSFDPIVLSEHISD GTHVACMGTDTIGKQEVAADLLTRATVFTDEVAQSTTLGEAQHAVANGSLTADQITQLGAVINGTHGGRA SDREVTLFDGTGVGLQDLAVAARVVELAIEKGTAIEVDF |
| 100 | MYIVPERAIADLMTREAAFDAVEKVFAAMAAGDAYNFPVVREAIGHEDALYGFKGGFDQAGLTLGLKAGG YWPNNLEKRDLINHQSTVFLFDPDTGKAKAMVGGNLLTALRTAAASSVSIKHLARDDAKVIGMIGAGHQA TFQLRAALEQRTFEKVIGWNYHPDMLPNIEKVATEAGVPFEAVDLPGMAEADVIISITSAFAPSLMADHVA PGTHIACMGTDTKGKQEVEAALLARATVFTDEVAQSVSIGEAQHAVADGLIAEGDVHQLGAVINGTHAGR ASADEITLFDGTGVGLQDLAVAASVVDLAIKKGVAIEVDF |
| 101 | MIIVPEREISGLISAADCFTAVEQVFASMARKSATNFPVIREAIGHAGALYGFKSGFDRESLALGLKSGGFW PNNVEKGLTNHQSTIFLFDADTGRCRAVVGGNLLTALRTAAASAVSIKYLARRDAQVIGIVGAGHQSTFQL RAALDQRAFKKVVGWNIDPEMLSRLQVVAAERNIPFESVDLDRLGAEADVIITITSSFASLLKAAQVRPGT HLACMGTDTKGKQEVEAELVAMATVFTDEVAQSISIGEAQHAVEKGLLAAGDIIELGQVINGMHPGRSSD DEITLFDGTGVGLQDLAVASAAVDLAIARGVALEVDF |
| 102 | MIIVPERLISDLMSEAAVFEAIESVFAAMARDEARNFPVIREAIGYADALYGFKAGFDSAGLVLGVKAGGY WPGNMAKGLTNHQSTVLLFDPDTGRIKAAVGGNLLTALRTAAASAVSIKHLARPDARVLGMVGAGHQSA FQMRAAVRARKFDKVVGWNLHPEMLSRLADTAVELGLPFEVVDLPQLGAQADVIITITSSFAPILLSGHIRP GTHLACMGTDTKGKQEVEAALFPRARLFADEVEQSVTIGEAQHAVAQGLIATGDITPLGAVIAGLAPGRTS PEEITLFDGTGVGLQDLAVASVAVDIARARGLALEVEL |
| 103 | MNTHKEVAADGFVIVGEEICQKIISRADAFGAVEAVFAAMARGDAYNFPVVREAIGHADALYGFKGGFDR SGLSLGLKAGGYWPGNMDKGLTNHQSTVFLFDPDTGRLSALVGGNYLTAIRTAASSSVSIAHLARKDAKV LGMVGAGHQSAFQLRAAVEQRAFEKVVAWNPHPDMLPRLGAVAKELGLEFEAVTQEELGAQADVIITITS AFEPLMMADWVKPGTHIACMGTDTKGKQEVDPALFTRATVFADEIAQSITIGEAQHAVGKGLIAEGDITPI GAVINGTHGGRSNAEEITLFDGTGVGLQDLAVASVAAKLAREQGLVTPITLG |
| 104 | MIIVPEHAIDGLLTEAECFGAVEQVFASMARRRAGNFPVVREAIGHADALYGFKSGFDRDSLALGLKAGG FWPGNAAKGLTNHQSTVFLFDADTGRCRAVVGGNLLTALRTAAACAISIRHLAREGARVLGMIGAGHQS AFQLRAALAQRPFERVLAWNLHPGMFGRMEAVARERGVPFEVVDLDRLGAEADVVVTITSSFAPILKAAQ VRPGTHVACMGTDTRGKQEVEAELLAAATVFTDEVAQSVSLGEAQHAVARGLLAADSIVEIGAVINGDHP GRVSDAEITVFDGTGVGLQDLAVAAVAVDRAVAKGLATEVDF |
| 105 | MACLGSGQGVLTKEGHRPSCNQSEGKMIIVPESQIPALVTSADCFVAVEDVFASMSKQSAYNFPVIREAI GHADALYGFKSGFDRESLALGLKSGGFWPNNIHKGLANHQSTVFLFDADTGKCRAIVGGNLLTALRTAAA SAVSIKYLARQDAKVLGMIGAGHQSTYQLRAAVEQRPFEKVLAWNFHPEMLSRLEDVAKELELPFETVDL DRLGAEADVIISITSSFAPILKASQVRPGTHLACMGTDTKGKQEMDADLVAGATVFADEVAQAVTIGECQH AFEKGLITRDDIIELGAVITGRHPGRSSPEEITLFDGTGVALQDLAVASAAVELALSRGTAIEVDF |
| 106 | MLIVPEREIADLMTREAAFSAVEQVFAAMAAGNAYNFPVVREAIGHEDALYGFKGGFDRAGLTLGLKAGG YWPHNLEKRGMINHQSTVFLFDPDTGKAKAMVGGNLLTALRTAAASSVSIRHLAREDAKVIGMVGAGHQ ATFQLRAALEQRDFDKVIGWNLHPEMLPNLEKVAAEAGLPFEAVELEGMRAADVIISITSSFDAILMEEHV APGTHIACMGTDTKGKQEVAPALLAKATVFTDEVSQSVSIGEAQHAVAQGLIRETDISQLGAVINGAHPGR RSAEEITLFDGTGVGLQDLAVAAAVVDLAVEKGIAIEVDF |
| 107 | MLIVPEREIGALMTRASAFEAVEKVFAAMASGEAYNFPVIREAIGHEDALYGFKGGFDRAGLTLGLKAGGY WPNNLEKFKVINHQSTVFLFYPDTGKVAAMVGGNLLTALRTAAASSVSIAHLARRDAKVMGMVGAGHQA TFQLRAALEQRPFEKVIGWNLHPEMLPNIETVADEAGLPFEAVPLEGMREADVIVSITSSFAPSLMAAHVS PGTHLACMGTDTRGKQEVEAALLAVATVFTDEVAQSVSIGEAQHAVAEGLISESDVHQIGAVINGSHPGR RSDEEITLFDGTGVGLQDLAVAAAVVDLAVEKGIAIEVDV |
| 108 | MYIVPEKAIADLVTREASFDAVEKVFAAMAAGDACNFPVVREAIGHEDALYGFKGGFDRAGLTLGLKAGG YWPNNLEKRGLINHQSTVFLFDPDTGKVKAMVGGNLLTALRTAAASSVSIKHLARQDAKVIGMIGAGHQA KFQLRAALEQREFEKVIGWNLHPEMLPNLQEVADEAGLPFEAVELDGMREADVIISITSSFDAILKADQVS PGTHIACMGTDTKGKQEVDPQLLVKADVFTDEVAQSISIGEAQHAVTQGLIQEADVAQIGAVINGTNPGRT SDDQITLFDGTGVGLQDLAVAASVVDVAVEKGVAIEVDF |
| 109 | MAKRSAYNFPVIREAIGHADALYGFKSGFDRDSLALGLKSGGFWPNNVQNGLANHQSTVFLFDADTGRC RAVVGGNLVTALRTAAASAVSIKYLARKNAKVLGMIGAGHQSTYQLRAAVEQRPFEKVLAWNLHPEMLS RLEGVARELELPFETVDLDRLGDEADVIISITSSFAPILKASQVRPGTHLACMGTDTKGKQEMDAELIAAAT VFTDEVAQAVTIGECQHAIEKGLISKDDIVEIGAVITGRHKGRSSPEEITMFDGTGVALQDLAVASAAVAHA VSRGTAIEVDF |

FIG. 12I

| | |
|---|---|
| 110 | MLVVAEKEIAGLMTPEAAFEAIEAVFASMARRKAYNFPVVREAIGHEDALYGFKGGFDAAALTLGLKAGG YWPNNQKHGLINHQSTVFLFDPDTGRVSAAVGGNLLTALRTAAASAVSIKHLAPKGAKVLGMIGAGHQSA FQMRAAANVHRFEKVIGWNPHPEMLSRLADTAAELGLPFEAVELDRLGAEADVIISITSSFSPLLLNEHVK GPTHIAAMGTDTKGKQELDPALVARARVFTDEVAQSVSIGECQHAIASGLIREDQIGELGAVVAGDDPGR GDAEVTIFDGTGVGLQDLAVAQKVLEIAKQEGLAQEVEI |
| 111 | MLVVAEKEIAGLMTPEAAFEAIEAVFASMARRKAYNFPVVREAIGHEDALYGFKGGFDASALTLGLKAGG YWPNNQKHNLINHQSTVFLFDPDTGRVSAAVGGNLLTALRTAAASAVSIKYLAPKGAKVLGMIGAGHQSA FQMRAAANVHRFEKVIGWNPHPEMLSRLADTAAELGLPFEAVELDRLGTEADVIISITSSFSPLLMDQHVK GPTHVAAMGTDTKGKQELDPALVARARVFTDEVAQSVSIGECQHAIASGLIREDQIGEIGAVVAGDNPGR GDAEVTIFDGTGVGLQDLAVAKAVVELAKHKGVAQEVEI |
| 112 | MEAEKGVVVVSEATCEEVIDRASSFTAVESVFAAMARGDAYNFPVVREAIGHADALYGFKSGFDRAGMS LGVKSGGYWPGNVNLGIPNHQSTVFLFDPDTGRLKAMVGGNYLTAVRTAASSAVSINHLARKDAKVLGM VGAGHQSKFQLRAAADQRDFEKVVAWNPHPEMLPGLKAVADELGLPFESVEREELCAQADVIITITSAFE ALLMKEWIKPGTHIACMGTDTKGKQEVDTALVESATLFTDEIVQSITIGENQHAIESGAISESDITPIGDVING KHPGRSHADEITLFDGAGVGLQDLAVASVAVDLALEKDQAQHVSL |
| 113 | MFVVAEKEIAGLMTPEAAFEAIEAVFASMARRKAYNFPVVREAIGHEDALYGFKGGFDASALVLGLKAGG YWPNNQKHNLINHQSTVFLFDPDTGRVSAAIGGNLLTALRTAAASAVSIKYLAPKGAKVLGMIGAGHQSA FQMRAAAAVHGFEKVIGWNPHPEMLTRLADTAADLGLPFEAVELDRLGAEADVIISITSSFSPLLMDQHVK GPTHIAAMGTDTKGKQELDPALVARARVFTDEVAQSVTIGECQHAIAAGLIAEEAIGELGAVVSGDDPGRD GAEVTIFDGTGVGLQDLAVAQKVLEIAKEKGLAQEVEI |
| 114 | MMNTQQQVAADGFVIVGEEICQKIISRADAFGAVEAVFAAMASGDAYNFPVVREAIGHADALYGFKGGFD RSGLSLGLKAGGYWPGNMDKGLTNHQSTVFLFDPDTGRLSALVGGNYLTAIRTAASSSVSIAHLARKDSK VLGMVGAGHQSTFQLRAAVEQRAFEKVVAWNPHPDMLPRLGAVAKELGLEFEAVTQEELGAQADVIITIT SAFEPLMMADWIKPGTHIACMGTDTKGKQEVDPALFTRATVFADEIAQSITIGEAQHAVAKGLIAEGDITPI GAVINGTHGGRASEAEITLFDGTGVGLQDLAVASVAAKLAREQGLVTPITLG |
| 115 | MDTSSEALTQPHQILIVSEDACQKVIGRHEAFQAVESVFSSMAKGSAYNFPVVREAIGHANALYGFKSGF DSEGLVLGVKAGGYWPGNVVQGRTNHQSIVALFDPDTGQLKALIGGNYLTAIRTAASSAVSIAHLARKNA KVLGMIGAGFQSTFQLHAALEQRDFEKVVAWNTHPEHLTRLADVCREHGLPFEAVSLQTLGAQSDVIITIT SASEPLLQAAWIKPGTHLACMGTDTKGKQEVDQQLLARASVFTDEIAQSISIGEAQHAVAAKILFAEQITPI GEVINGSHQGRQSEQEITLFDGTGVGLQDLAVASAAASLAEVRGLAQRVTL |
| 116 | MIIVPENQIAELITPADCLVAVEGVFASMAKRSAYNFPVIREAIGHADALYGFKSGFDRESLALGLKSGGFW PNNVREGLANHQSTVFLFDADTGRCRAIVGGNLLTALRTAAASAVSIKYLARKDAKVLGMIGAGHQSTYQ LRAAVEQRPFEKVLAWNLHPEMLSRLEGVARELELPFETVDLDRLGAEADVIISITSSFAPILEASQVRPGT HLACMGTDTKGKQEMDAELLAAATVFTDEVAQAVTIGECQHAIEKGLISRDNIVEIGAVITGCHTGRSSPE EITLFDGTGVGLQDLAVASAAVELALSKGTAIEVDF |
| 117 | MIIVPESAIGELISLEDCVDAVEKVFVSMAERSAHNFPVVREAIGYADALFGFKSGFDREGLALGLKAGGF WPNNADKGLTNHQSTVFLFDPETGRCRAVVGGNLLTALRTAAASAVSIKHLARRDAKVLGMVGAGHQAS FQLRAAVQQRQFEKVVAWNYHPEMLPKLAAVAEELAVPFEAVDLDRLGDEADVIITITSSFQPILKASQIRP GTHLACMGTDTKGKQEVDPALVAAATLFTDEIAQAISIGECQHAVAQGMIAPIDIAEIGAVINGQKSGRTSL EEVTLFDGTGVGLQDLAVAQAAVELALARGIAVEVDF |
| 118 | MLIVPEREIANLMTRAAAFDAVEQVFAAMAAGDAYNFPVVREAIGHEDALYGFKGGFDRAGLTLGLKAGG YWPNNLEKRDLINHQSTVFLFDPDTGKARAMVGGNLLTALRTAAASSVSIKHLARKDARVIGMVGAGHQA TFQLRAALEQRDFDKVIGWNYHPEMLPNIEKIAREAGVPFQAVDLPGMVEADVIISITSAFSPSLMADHVA PGCHLACMGTDTKGKQEVEAALLARATVFTDEVAQSVSIGEAHAVAEGLIAESDVHQLGAVINGTHAGR VSDDQITLFDGTGVGLQDLAVAAAVVDLAVAQGIAIEVDF |
| 119 | MLIVPEREIPDLLTRGASFDAVEKVFAAMAAGDAYNFPVVREAIDHEDALYGFKGGFDAKGQVLGLKAGG FWPNNMERRQIINHQSTVFLFDPDTGRVAAMVGGNYLTALRTAAASSVSIRHLARGDAKVLGMIGAGHQ ASFQLRAALEQREFERVIAWNYHPEMLPNLAKICDEVGVPFQAVELDGMREADVIVSITSAFAPSLMADH VAPGTHVACMGTDTKGKQEVEAQLLARATVFADEVAQSVSIGEAHAIAEGLIDKAGIHQIGAVINGTHPG RRSDGEITLFDGTGVGLQDLAVAAAIVDLAKAKGVAIEVEF |
| 120 | MGGSIEERSFEELSPVDAGAGISLVSEAVCEQVVGRPEAFTAVESVFAAMASGAAYNFPVVREAIGHADA LYGFKSGFDRAGMVLGVKSGGYWPGNVDKNLTNHQSTVILFDPDTGQLRSLVGGNYLTAVRTAAASAV SIAHLARKDARVLGMVGAGHQSTFQLRAALEQRNFEKVVAWNPHPEYLSRLAAVCEELGMPFAAVERE QLGAEADVIITITSAFEPLLMKQWIKPGTHIACMGTDTKGKQEVDPELLASASVFTDEVAQSISIGEAQHAV ASGLLNEADITPIGEVINGTHPGRRDDLEITLFDGTGVGLQDLAVASAAVELAQAKGLAGQVSL |
| 121 | MWIVPESAIGGLVDDQSAFDAVEATFAAMARDDAYNFPVVREALGEGRQYGFKSGLDRAGAQLGVKAG GYFPGNAAKGIINHQSTVFLFDPDTGILQAAVGGNLLTALRTAAASAISIAHLSRADSTVLGMVGAGHQSV FQMRAALRQRKFERVVAWNYHPDMMDRLASAVAEEGLPFEEVSLEELGAQADVIITITSSPAASLMDAHV RPGTHIACMGTDTIGKQEVDPALLARAAVFTDEVAQSVTIGEAQHAIAQGLIKPEDITPIGAVINGAHKGRT SAEEITLFDGTGVGLQDIAVASKAVDLARANGSAIEVAL |

FIG. 12J

| | |
|---|---|
| 1 | MIIVPEHAIDGLLTEAECFTAVEQVFASMARRRAGNFPVVREAIGHADALYGFKSGFDRDSLALGLKAGGF |
| 2 | WPGNAAKGLTNHQSTVFLFDADTGRCRAVVGGNLLTALRTAAACAISVRHLARKDARVLGMIGAGHQSA |
| 2 | FQLRAALAQRPFERVLAWNLHPGMFGRMEAVAREHGVPFEAVDLDRLGSEADVVVTITSSFAPILKAVQV |
| | RPGTHLACMGTDTRGKQEVEAELLAAATVFTDEVAQSVSIGEAQHAVARGLLAADSIVEIGAVINGDHPG |
| | RVSESEITLFDGTGVGLQDLAVAAVAVDRAVAKGLATEVEV |
| 1 | MQIVSEKAVKAAVSRADAFTAVESVFAAMATGQAWNFPVVREAIGHADALYGFKSGFDRDHMALGVKS |
| 2 | GGYWPGNAARGLTNHQSTVLLFDPDTGQPRALVGGNYLTAVRTAAASAVSIQHLARPDAKTLGIVGAGH |
| 3 | QAPFQLRAAVEQRPIERVVAWNRSPERLESLREAAQAMGLPFEAVDRDTLCEQADVIITITSCFEPLLTRE |
| | QIRPGTHIACMGTDTAGKQEIDPAILASAEVFTDDPTQAATIGECQHAVAQGHIHRDAIRPVGGVIGEPGS |
| | FRRSAEAITVFDGTGVGLQDLAVARVALERAVEAGTAVRIDL |
| 1 | MSDQHNNQGVVVVTEEVCQAIMGRSDAFTAVENVFAAMSKNTAYNFPVIREAIGHADALYGFKSGFDRD |
| 2 | SMVLGLKSGGYWPGNVEKGLTNHQSTVILFDPDTGKLKSLVGGNYLTAVRTAASSAVSIAHLARQDSKVL |
| 4 | GMIGAGHQSTFQLRAAVEQRNFEKVVGWNIDPERLSILAEVCAELSLPFESVSREELCALSDVIITITSAFE |
| | ALLDNAWIKPGTHIACMGTDTKGKQEVDAKLFRTATVFTDELAQSITIGEAQHAIQSGLIVESDIVPIGEVIN |
| | GTNSGRTSEDEITLFDGTGVGLQDLAVASVAAELAQAKGQAFYINL |
| 1 | MSANTDDGLLIVSEEICEQVIRRPDAFSAVEAVFGAMARGDAYNFPVVREAIGHADALYGFKSGFDRAGM |
| 2 | VLGVKAGGYWPGNMAKGLTNHQSTVCLFDPDTGRLVALVGGNYLTALRTAASSAVSIAHLARKDAKVLG |
| 5 | MVGAGHQSTFQLRAAVEQRDFERVVAWNPHPDMLPRLAAVAEELGLAFEAVTPEGLGAQADVIITITSAF |
| | EPLIMADWIKPGTHIACMGTDTKGKQEVDPALFKSATVFADEIAQSITIGEAQHAVASGLIGEGDLTAIGEVI |
| | NATHPGRSSDDEITLFDGTGVGLQDLAVASVAARLAREQGLVTPVAL |
| 1 | MIIVPEREIADLMTREVAFNAVEGVFAAMAAQDAYNFPVVREAIGYEDALYGFKGGFDKAGMTLGLKAGG |
| 2 | YWPHNLDKHQLINHQSTIFLFDPDTGRVTAMVGGNLLTALRTAAASSVSIKHLARKDSKVIGMIGAGHQAT |
| 6 | FQLRAALEQREFEKVIGWNYHPEMLPNLEKVANEAGLPFEAVELDQLGHDADVIISITSAFAPSLLAKHVS |
| | AGTHIACMGTDTKGKQEVESALLARATVFTDEVAQSISIGEAQHAVAEGLIKESDVNQIGAVINGTHPGRV |
| | AADEITLFDGTGVGLQDLAVAASVVALAVKKGVAIDVDF |
| 1 | MYIVPEKAIADLVTREASFDAVEKVFAAMAAGDAYNFPVVREAIGHEDALYGFKGGFDRAGLTLGLKAGG |
| 2 | YWPNNLEKRGLINHQSTVFLFDPDTGKVKAMVGGNLLTALRTAAASSVSIKHLARQDAKVIGMIGAGHQA |
| 7 | TFQLRAALEQRQFEKVIGWNYHPEMLPNIEKVAAEAGLPFEAVDLPGMAEADVIISITSAFAPSLMADHVS |
| | PGTHVACMGTDTKGKQEVEAELLVKASVFTDEVAQSISIGEAQHAVAQGLIQESDVAQIGAVINGTNPGR |
| | TSDDQITLFDGTGVGLQDLAVAASVVEVAVEKGIAIEVDF |
| 1 | MWVVPEKEIAGLMTPEAAFDAVEAVFAAMASGEANNFPVVREAIGHEDALYGFKGGFDKSALNLGLKAG |
| 2 | GYWPNNQKRDLINHQSTVFLFDPDTGRVSAAVGGNLLTALRTAAASAVSIKHLAPEGAKVLGMIGAGHQS |
| 8 | AFQMKAAARVGNFERVIGWNPHPEMLTRLADTAAELGLPFEAVELPRLGAEADVIISITSAFEPLLMDAHV |
| | KGRTHIAAMGTDTKGKQELDPALVARARLFTDEIAQSLSIGEFQHASAAGSISDGDVTAIGQVITGNHEGR |
| | GDAEITIFDGTGVGLQDLAVAGAVVDLARQQGKAVEVEI |
| 1 | MFIVPEKEIAGLVSADQCFEAVEAVFAAMARGDAYNFPVIREAIGHAEALYGFKSGFDRAGAVLGLKSGG |
| 2 | YWPGNAAKGLTNHQSTVVLFDPDSGRPAALVGGNLLTALRTAAASAVSIRYLARSDARVLGVLGAGHQS |
| 9 | AFQLRAAVAQRRFEKIVGWNYHPEMLPRLAETAAELGLPFEAVSLEDFGAQADVIVTISSSFSAQLMDAH |
| | VRPGTHLACMGTDTTGKQEIDPAIFVRARVFADEIAQSVEIGEAQHAVAAGLIAAEDIVEIGAVINGTAPGR |
| | QSDDEITVFDGTGVGLQDLAVAARAVAAARARGVAVEVDL |
| 1 | MFIVPEREIADLMTRDAAFDAVESVFAAMASKDAYNFPVIREAIGHEDALYGFKGGFDKAGMTLGLKAGG |
| 3 | YWPNNLEKHGHINHQSTIFLFNPDTGMVSAMVGGNLLTALRTAAASSVSIKHLARKDAKVMGMVGAGHQ |
| 0 | ATFQLRAALEQRQFEKVIGWNYHPEMLPNIEKIAIEAGLPFEAVELDGMREADVVISITSTFAPTIMADHIAP |
| | GTHIACMGTDTKGKQEVEAALLARATVFTDEVAQSVSIGEAQHAVAQGLIKESDVHQLGAVINGTHKGRT |
| | SDDEITLFDGTGVGLQDLAVAASVVELAVAKGVAIEVDF |
| 1 | MSANTDDGLLIVSEEICEKVIRRPDAFSAVEAVFGAMARGDAYNFPVVREAIGHADALYGFKSGFDRAGM |
| 3 | VLGVKAGGYWPGNMAKGLTNHQSTVCLFDPDTGRLTALVGGNYLTALRTAASSAVSIAHLARKDAKVLG |
| 1 | MVGAGHQSTFQLRAAVEQRDFERVVAWNPHPDMLPRLAAVAEELGLAFEAVTPEELGAQADVIITITSAF |
| | EPLIMADWIKPGTHIACMGTDTKGKQEVDPALFKSATVFADEIAQSITIGEAQHAVASGLIGEGNLTAIGEVI |
| | NGTHPGRSSAEEITLFDGTGVGLQDLAVASVAARLAREQGLVTPVAL |
| 1 | MIIVPEKEIAGLVSAEDSFSAVEAVFAAMARGDAYNFPVIREAIGHADALYGFKSGFDRAGLVLGLKSGGY |
| 3 | WPGNAEKGLTNHQSTVVLFDADTGQAHALVGGNLLTALRTAAASAVSIKHLARDDAKVLGMVGAGHQSA |
| 2 | FQMRAAAAQRDFERVVGWNYHPEMLPRLAETAEELGLPFEAVSLEELGAQADVIVTITSSFEAQLKDTHV |
| | RPGTHLACMGTDTKGKQEVDPAILARARVFTDEVAQSITLGEAQHAVAAGLIGEGDITQIGAVIEGTAAGR |
| | QSAEEITLFDGTGVGLQDLAVAAKAVDLAQEKGAAIDVAF |
| 1 | MYIVPERAIADLMTRDAAFDAVEKVFAAMAAGDAYNFPVVREAIGHEDALYGFKGGFDRAGLSLGLKAGG |
| 3 | YWPNNLEKRGLINHQSTVFLFDPDTGKVRAMVGGNLLTALRTAAASSVSIKHLAREDAKVIGMIGAGHQA |
| 3 | KFQLRAALEQRDFDKVIGWNLHPEMLPNLEEVATEAGLPFEAVELDGLKEADVIISITSSFDAILQADQVSP |
| | GTHIACMGTDTKGKQEVDPQLLVRATVFTDEVAQSTSIGEAQHAVAQGLIAEADVAQLGAVINGAHPGRS |
| | SAEQITLFDGTGVGLQDLAVAASVVELAVKKGIAIEVDF |

FIG. 12K

| | |
|---|---|
| 133 | MIIVPEAVIADLITPEASFTAVERVFASMAARSAYNFPVIREAIGHADALYGFKSGFDRAALNLGLKSGGYW PGNAAKGLTNHQSTVFLFDADTGKCRAVVGGNLLTALRTAAAAAVSVAHLARPDAKVLGIVGAGHQAAF QLRAVAAQRPFEKIVAWNRSPEKLETLRGVADELGLGFESVSIEDLGGQADVIVTITSSHDAILHGAQVKP GTHVACMGTDTKGKREVDNDLIAAATLFTDEVAQSTTIGECQHAIVDLTIRPEDITELGAVINGDHKGRTSA EEITLFDGTGVGLQDLAVASAVVELAMSRGVATEVDF |
| 135 | MTTQEGLLIVGEDLCEQLVGRQQAFDAVQSVFGAMANGGARNFPVVREALGYADALYGFKSGFDRDGQ VLGVKSGGYWPGNAEQGLTNHQSTVFLFDPDTGRLSALVGGNYLTAVRTAASSAVSIAHLSRKDAKVLG MVGAGHQSAFQLRAAAEQRGFEKVVAWNPHPDMLPRLAAVAEEIGLEFEAVSQQELGAQSDVIITITSAF EPLLMKDWIKPGTHLACMGTDTKGKMEVDPALVASATVFTDEVAQSATIGEAQHAMGSGTLTETQITPIG AVINGDHPGRSSVDEITLFDGTGVGLQDLAVASVAARLADEAGLAQRATL |
| 136 | MIIVPERAIADLIGSAECFTAVEQVFAAMARKSAYNFPVVRESIGYADALYGFKSGFDRESLSLGLKSGGF WPKNAEKGLTNHQSTVFLFDADTGRCRAVVGGNLLTALRTAAASAISIKYLAREDAKILGIIGAGHQSTFQL RAAVQQRNFEKVVAWNYHPEMLTRLEDVAKEVGLPFEAVDLHRLGAEADVIISITSSFRPSLMASQVRPG THLACMGTDTKGKQEVDAKLVAASSLFTDEVAQAITIGECQHAIAAGLIAAEDILEIGAVITGEEKGRRSAD DITLFDGTGVGLQDLAVASAVVDLAVSKGVAIEVDF |
| 137 | MIIVPERAIADLIGSAECFTAVEQVFAAMARKSAYNFPVVRESIGYADALYGFKSGFDRESLSLGLKSGGF WPKNAEKGLTNHQSTVFLFDADTGRCRAVVGGNLLTALRTAAASAISIKYLAREDAKILGIIGAGHQSTFQL RAAVQQRNFEKVVAWNYHPEMLTRLEDVAKEVGLPFEAVDLHRLGAEADVIISITSSFRPSLMASQVRPG THLACMGTDTKGKQEVDAKLVAASSLFTDEVAQAITIGECQHAIAAGLIAAEDILEIGAVITGEEKGRRSAD DITLFDGTGVGLQDLAVASAVVDLAVSKGVAIEVDF |
| 138 | MIIVPENQIAGLITPADCLVAVEGVFASMAKKSAYNFPVIREAIGHADALYGFKSGFDRDSLALGLKSGGF WPNNVEKGLANHQSTVFLFDADNGRCRAVVGGNLLTALRTAAASAVSIKYLARKDAKVLGMIGAGHQST YQLRAAVEQRPFEKVLAWNLHPEMLSRLEEVARELELPFETVDLDRLGAEADVIISITSSFAPILKASQVRP GTHLACMGTDTKGKQEMDPELIAAATVFTDEVAQAVTIGECQHAIDKGLISKGDIVEIGAVITGRHKGRSS PEEITLFDGTGVGLQDLAVASAAVELALSKGTAIEVDF |
| 139 | MLIVPESKIADLMTPEAAFDAVEATFAAMARKSAYNFPVIREAIGHADALYGFKSGFDRESLVLGLKSGGY WPGNAEKGLTNHQSTIFLFDADTGKCSAIVGGNLLTALRTAAASAVSIKHLARQDSEVLGMIGAGHQSVF QMQAAVKQRNFKKVIGWNYHPEMLSRLADCAAELGLPFEEVSLETLGRDADVIISITSSFAPTLLDAHVTP GTHIACMGTDTKGKQEVEATLLKRATVFTDEIAQSISIGEAQHAVAAGLIAQSDITEIGAVINGTHPGRSSA DEITLFDGTGVGLQDLAVAAKVVELAQQKGVALDVDF |
| 140 | MIIPEREIAGLISAADCFVAVERVFASMARRSAYNFPVVRESIGHASALYGFKSGFDRENLSLGLKAGGF WPDNAEKGLTNHQSTVFLFDADTGRCRAIVGGNMLTALRTAAASAVSIKYLARADAKVLGMIGAGHQSTF QLEAALDQKLFEKVLGWNIEPNALSRLEAVALKRNIPFERVSLDRLGAEADVIITITSSFAPILKTVQVRPGT HLACMGTDTKGKQEVEASLVAAATVFTDEIGQSIAIGEAQHAINEGLMEADEIVEFGNVVCGNHRGRTSA DEITLYDGTGVGLQDLAVASAVVELAITRGVATEMDL |
| 141 | MYIVPEAMIADLVSREASFEAVEQVFAAMAAKDAYNFPVVREAIGHEDALYGFKGGFDRVGGALGLKAG GYWPHNLEKRGLINHQSTVFLFDPDTGKVRAMGGNLLTALRTAAASSVSIKHLARADARVMGMVGAGH QATFQLRAALEQRPFEKVIGWNYHPEMLPNIEKVANEAGVPFEAVDLPGMAEADVIISITSAFAPSLMADH VSPGTHLACMGTDTKGKQEVESALLARAKVFTDEVAQSVSIGEAQHAVAAGLIAESDVTEIGAVINGTHP GRTSGDDITLFDGTGVGLQDLAVASKVVDLAIERGVAIEVDF |
| 142 | MTTPASGAGNPVSIVSEAVCQQIVGRPEAFKAVENVFAAMARGDAYNFPVVREAIGHADALYGFKSGFD RAGMALGVKSGGYWPGNVQKDLTNHQSTVILFDPDTGQLKSLVGGNYLTAVRTAAASAVSIAHLARRDA KVLGMVGAGHQSTFQLRAALEQRDFEKVVAWNPHPEHLPRLAAVCEELRVPFEAVTQQELGAQADVIITI TSAFEPLLLKEWIKPGTHIACMGTDTKGKQEVDPALLAAASVFTDEVAQSISIGEAQHAVASGLIAEADITPI GKVINGTHVGRRDDQEITLFDGTGVGLQDLAVASAAAELAEQQGLSQKIIL |
| 143 | MIIVPEKEIAGLIGRQESFDAVESVFAAMASGAACNFPVIREAIGHADALYGFKSGFDRSSLALGLKSGGY WPGNMAKGLTNHQSTVFLFDADTGKAKAVVGGNLLTALRTAAASAVSIKHLARKDAKVLGMIGAGHQSA FQMRAAAEQRSFEKVLGWNLHPEMLVRLEATANELGLPYESVDLARLGAEADVIISITSSFDPILMEEHVT PGTHIACMGTDTKGKQEVDTALVAKAKLFTDEVAQSATIGECQHAVASGIVSEDNIIEIGAVINGNHPGRIS QSDITLFDGTGVGLQDLAVASAAVDLAIQKGVAIEVDF |
| 144 | MKDTPQQGDGVLIVGEEACRALVGRAEAFAAVEAVFAAMASGEARNFPVVREAIGHADALYGFKSGFDR AGMALGVKAGGYWPGNAGRGLTNHQSTVCLFDPDTGRLSALVGGNYLTAVRTAASSAVSIAHLARRDA KVLGMVGAGHQSAFQLRAAAEQRAFEKVVAWNPHPEMLPQLAEVAASLGLPFEAVTPEELGAQADVVIT ITSAFEPLLMRDWIRPGTHVACMGTDTKGKMEVDAALLAAATVFTDEVAQSVSLGEAQHAVAGGLLSEG DITPIGAVINGTHPGRTSDDEITLFDGTGVGLQDLAVASVAARLAEAQGVAARVVL |
| 145 | MIIVPEKEMAGLLNRADAFTAVENVFASMSKGDAYNFPVIREAISHEDALYGFKGGFDKAGMALGLKAGG YWPNNLEKHGHINHQSTVFLFDPDTGMVKAMVGGNLLTALRTAAASSVSIKHLARKDARVMGMVGAGH QATFQLRAALEQREFEKVIGWNYHPEMLPNIEKVADEAGVPFEAVPLEGMVEADVVISITSTFAPTIMADHI SPGTHIACMGTDTKGKQEIEAALLAQTTVFTDEVAQSISIGEAQHAIAEGMIQQSDVNELGAVINGTHPGR TSDDEITLFDGTGVGLQDLAVAASIVDVAVEKGIATIVEF |

FIG. 12L

| | |
|---|---|
| 144 | MNDLSAQAPKAAQAGNTVTIVPEAEIAGLMTPEAAFDAVEATFAAMARGDAYNFPVIREAIGHADALYGF KSGFDRESLALGLKSGGYWPGNEARGLTNHQSTVILFDADTGRPSALVGGNLLTALRTAAASAVSIRYLA RQDAKVLGMIGAGHQSAFQMRAAVQQRSFEKVVGWNYHPEMLSRLADTAAELGLSFEAVSLEELGAQA DVIVTITSSFAPSLLDAHVRPGTHLACMGTDTNGKQEVEAGLLARARVFTDEVAQSVTLGEAQHAVAEGLI SADDITQLGAVINGIHPGRSSDQEITLFDGTGVGLQDLAVAAAVVRLAREQGVASEVVL |
| 147 | MIIVPEKEIGALLGRKESYEAVEQVFAAMASGDAYNFPVVREAIGHEDALYGFKGGFDKAGQVLGLKAGG YWPHNLEKRGLINHQSTVFLFDPDTGMPTAMVGGNLLTALRTAAASSVSINHLARKDARVIGMVGAGHQ ATFQLRAALEQREFEKVIGWNLHPEMLPNIEKVAAEAGLPFEAVELPGMTQADVIVTITSSFAPTLLSDHV ADGTHVACMGTDTIGKQEVGTDLITRASVFTDEVAQAITLGESQHAVKAGTKAEADIHQIGAVINGTHTGR SSDDEVTLFDGTGVGLQDLAVASAVVDLAIKQGIAIKVDI |
| 148 | MIIVPEKEIGALLGRKESYEAVEQVFAAMASGDAYNFPVVREAIGHEDALYGFKGGFDKAGQVLGLKAGG YWPHNLEKRGLINHQSTVFLFDPDTGMPTAMVGGNLLTALRTAAASSVSINHLARKDARVIGMVGAGHQ ATFQLRAALEQREFEKVIGWNLHPEMLPNIEKVAAEAGLPFEAVELPGMTQADVIVTITSSFAPTLLSDHV ADGTHVACMGTDTIGKQEVGTDLITRASVFTDEVAQAITLGESQHAVKAGTKAEADIHQIGAVINGTHTGR SSDDEVTLFDGTGVGLQDLAVASAVVDLAIKQGIAIKVDI |
| 149 | MYIVPERAIADLMTRDAAFDAVEKVFAAMAAGDAYNFPVVREAIGHEDALYGFKGGFDRAGLSLGLKAGG YWPNNLEKRGLINHQSTVFLFDPDTGKVRAMVGGNLLTALRTAAASSVSIKHLAREDAKVIGMIGAGHQA KFQLRAALEQRDFDKVIGWNLHPEMLSNLEEVATEAGLPFEAVELDGLKEADVIISITSSFDAILKADQVSP GTHIACMGTDTKGKQEVDPQLLVRATVFTDEVAQSISIGEAQHAVAQGLIAEADVAQLGAVINGAHPGRS SAEQITLFDGTGVGLQDLAVAASVVELAVKKGIAIEVDF |
| 150 | MLIVHEREIAALMTRDAAFSAVEKVFAAMADAKAYNFPVVREAIGHEDALYGFKGGFDRAGLTLGLKAGG YWPHNLEKRGEINHQSTVFLFDPDTGKAKAMVGGNLLTALRTAAASSVSIRHLARDDAKVLGMIGAGHQ ATFQLRAALEQRAFEKVIGWNLHPEMLPNLEKVAQEAGVPFEAVELPGMTEADVIITITSAFSPSLMAEHV SPGTHIACMGTDTKGKQEVEAALLSRATVFTDEVAQSVSIGEAQHAVAEGALKAEDIAQLGAVINGSHPG RQSAEEITLFDGTGVGLQDLAVAAAVVDLAVEKGVATEVDF |
| 151 | MLVVAEKEIAGLMTPEAAFEAIEAVFASMARRKAYNFPVVREAIGHEDALYGFKGGFDASALTLGLKAGG YWPNNQKHNLINHQSTVFLFDPDTGRVSAAVGGNLLTALRTAAASAVSIKYLAPKGAKVLGMIGAGHQSA FQMRAAANVHRFEKVIGWNPHPEMLSRLADTAAELGLPFEAVELDRLGTEADVIISITSSFSPLLMDQHVK GPTHVAAMGTDTKGKQELDPALVARARVFTDEVAQSVSIGECQHAIASGLIREDQIGEIGAVVAGDNPGR GDAEVTIFDGTGVGLQDLAVAKAVVELAKHKGVAQEVEI |
| 152 | MLVVAEKEIAGLMTPEAAFEAIEAVFASMARRKAYNFPVVREAIGHEDALYGFKGGFDASALTLGLKAGG YWPNNQKHNLINHQSTVFLFDPDTGRVSAAVGGNLLTALRTAAASAVSIKYLAPKGAKVLGMIGAGHQSA FQMRAAANVHRFEKVIGWNPHPEMLSRLADTAAELGLPFEAVELDRLGTEADVIISITSSFSPLLMDQHVK GPTHVAAMGTDTKGKQELDPALVARARVFTDEVAQSVSIGECQHAIASGLIREDQIGEIGAVVAGDNPGR GDAEVTIFDGTGVGLQDLAVAKAVVELAKHKGVAQEVEI |
| 153 | MTDNHQVVVVPEDLCEALVSRADAFQAVEQVFAAMASGDARNFPVVREATGHAEALFGFKSGFDKAGM ALGLKAGGFWPGNADKGLTNHQSTVFLFDPDTGRLQALVAGNYLTAVRTAASSSVSIRHLARPDAKVLG MVGAGHQAQFQLRAAAEQRAFEKVVAWNPHPDMLSKLEAVAREIGLPFEAVSQHELGAQAHVIITITSAF EPLLMRDWIKPGTHIACMGTDTKGKQEVDPELVAGARVFTDEVAQSVQLGETQHAVAQGLLAESDITPIG EVINKTHPGRQSDDEITLFDGTGVGLQDLAVAATAAKLAQQQGKAETVRL |
| 154 | MSNSQQNNLPKNKGVSVVSEEVCQQVMGRENAFSAVENVFSAMAKNTAYNFPVIREAIGHEDALYGFK SGFDRDGMVLGLKSGGYWPGNMAKGLTNHQSTVILFDPDTGKLKSLVGGNYLTAVRTAASSAVSIAYLA RKDSKVLGMIGAGHQSSFQLRAAVEQRDFEKVVCWNFHPEQIPNLAAVAEELGLPFESVTREELCAQAD VIITITSAFEALIDKNWIKPGTHIACMGTDTKGKQEVDAKLLAVASVFTDELAQSITIGEAQHAIAQKLIQQSDI VPIGEVINGTKPGRTSDEQITLFDGTGVGLQDLAVASVAAELAEEKGLATYFQL |
| 155 | MIVVPERIIAGLMTRADAFAAIEAVFAAMARGEARNFPVVREAIGHADALYGFKSGFDRAHLDLGLKSGGY WPGNAAKGLTNHQSTVVLFDADTGRCRALVGGNLLTALRTAAAAAVSVAHLARKDSRVLGIVGAGHQAA FQLRAVAEQRPFERVVAWNRSPEKLKGLACAAEEMGLPFESVSLDRLGAEADVIVTITSSFDAILGDAQV RPGTHLACMGTDTRDKKEVDPTLVARASVFTDEVAQAVTIGECQHAVALGLKGEADIVPLGAVINGDHPG RASEEEVTLFDGTGVGLQDLAVASRVVDLAVQKGLATQVEF |
| 156 | MLIVPERDIAKLLTRKAAFEAVEKVFASMAKGAARNFPVVREAIGHEDALFGFKGGFDRAGMTLGLKAGG YWPHNMAAHGVINHQSTVVLFDPDTGRLRAMVGGNLLTALRTAAASAVSIKHLARPDAAVLGMIGAGHQ AAFQLRAALEQRDLVKVIGWNRNPEKLAGLEAVAAEAGVAFETVDLDGMGEADVIITITSSFAPILEHGHV SPGTHVACMGTDTRGKQEVDPGLLARASVFTDQVAQSVSIGEAQHAVGQGLISEAEIGELGAVINKTLPG RTTDDQITLFDGTGVGLQDLAVAASVVEMAVDQGLAIEVAL |
| 157 | MIIVPEHAIDGLLTEAECFGAVEQVFASMARRRAGNFPVVREAIGHADALYGFKSGFDRDSLALGLKAGG FWPGNAAKGLTNHQSTVFLFDADTGRCRAVVGGNLLTALRTAAACAISIRHLAREGARVLGMIGAGHQS AFQLRAALAQRPFERVLAWNLHPGMFGRMEAVARERGVPFEVVDLDRLGAEADVVVTITSSFAPILKAAQ VRPGTHVACMGTDTRGKQEVEAELLAAATVFTDEVAQSVSLGEAQHAVARGLLAADSIVEIGAVINGDHP GRVSDAEITVFDGTGVGLQDLAVAAVAVDRAVAKGLATEVDF |

FIG. 12M

| | |
|---|---|
| 155 | MIIVPENQIAGLMTPADCLVAVEEVFASMAKRSAYNFPVIREAIGYADALYGFKSGFDRANLALGLKSGGF WPNNVQKGLANHQSSVFLFDADTGKCRAVVGGNLLTALRTAAASAISIKHLARKDAKVLGMIGAGHQSTF |
| 158 | QLRAAVEQCSFEKILAWNFHPEMLSRLEEVARELELPFEAVELDRLGAESDVIISITSSFAPILKASQVRPG THLACMGTDTKGKQEMEAGLVAAATVFTDEIAQAVTIGECQHAIERKLLSRADITELGAVITGRHPGRSSP DEITLFDGTGVGLQDLAVASAAVAHAVSRGTAIEVDF |
| 159 | MLIVPEREIADLMTREAAFAAVESVFAAMASGDAYNFPVVREAIGHEDALYGFKGGFDRAGLTLGLKAGG YWPHNLEKRKEINHQSTVFLFDPDTGKARAMVGGNLLTALRTAAASSVSIRHLAREEAKVLGMIGAGHQA TFQLRAALEQRPFEKVVAWNLHPEMLPNLEKVAQEADVPFEAVELPGMAQADVIITITSAFAPSLLAEHVS PGTHIACMGTDTKGKQEVEAALLTHATVFTDEVAQSVSIGEAQHAVADGTLKPGDIAQLGAVINGTHPGR QSAEEITLFDGTGVGLQDLAVAASVVDLAVEKGVAIEVDF |
| 160 | MIIVPETEIAGLVTPADCFRAVEGVFASMADKSAHNFPVVREAIGHADALYGFKSGFDRKGLALGLKAGGF WPNNVHKGLTNHQSTVFLFDPDTGKCRAVVGGNLLTALRTAAASAISIKYLARKDAKVLGMIGAGHQATF QLRAALAQRPFERIVGWNLHPDMLSRLEEVAKEEGLPFEAVDLDRLGAEADVIISITSSFAPMLKASQVRA GTHLACMGTDTKGKQEVEAEILAAAAVFTDEVAQAVTIGESQHAIERGLIREEAIVEIGAVINGTHPGRTSA DQITLFDGTGVGLQDLAVASAAVELALAKGVAIEVDF |
| 161 | MWIVPEREIADLLTRDASFDAVEKVFAAMAAGDAYNFPVIREAIGHEDALYGFKGGFDGVGGTLGLKAGG YWPHNLEKRNLINHQSTVFLFDPDTGKVAAMVGGNYLTALRTAAASSVSIKHLARTDAKVMGMVGAGHQ ATFQLRAALEQREFEKVIGWNYHPEMLPNIEKVANEAGVPFEAVELEGLGEADVVISITSTFAPTIMADHIS AGTHIACMGTDTKGKQEVEAALLARATVFTDEVAQSISIGEAQHAIEAGLIQEADVHQIGAVINATHKGRTS DDEITLFDGTGVGLQDLAVSAAIVRMAIEQGVAIEVDF |
| 162 | MLVVAEKEIAGLMTPEAAFEAIEAVFASMARRKAYNFPVVREAIGHEDALYGFKGGFDASALVLGLKAGG YWPNNQKHNLINHQSTVFLFDPDTGRVSAAVGGNLLTALRTAAASSAVSIKYLAPKGAKVLGMIGAGHQSA FQMRAAANVHRFEKVIGWNPHPEMLSRLADTAAELGLPFEAVELDRLGAEADVIVSITSSFSPLLMNEHV KGPTHIAAMGTDTKGKQELDPALVARARIFTDEVAQSVSIGECQHAIAAGLIREDQVGELGAVVAGDDPG RGDAEVTIFDGTGVGLQDLAVAQAVVELAKHKGVAQEVEI |
| 163 | MWVVPEKEIAGLMTPEAAFDAIESVFASMARRKAYNFPVVREAIGYEDALYGFKGGFDAAALTLGLKAGG YWPNNQKHGIINHQSTVFLFDPDTGRVAAAVGGNLLTALRTAAASAVSIKHLAPKGASVLGMIGAGHQSV FQMKAAARVNKFERVLGWNPHPEMLGRLADTAAELGLPFEAVELDRLGAEADVIIAITSSFAPLLMDGHV KGPTHIAAMGTDTKGKQELDPALVARARLFTDEIAQSVSIGEYQHVIAGNLVQQDAIGELGAVVTGDNPG REGDEVTIFDGTGVGLQDLAVAAAVVELAKQKGVAQRVEI |
| 164 | MMDQKVETQGIVIVGEEICQEVISRADAFSAVEAVFGAMAKGDAYNFPVVREAIGHADALYGFKGGFDKS GLTLGLKAGGYWPGNMEKGLTNHQSTVCLFDPDTGQLSALVGGNYLTALRTAASSSVSIAHLARKDSRV LGMVGAGHQSAFQLRAAAEQRDFDKVVAWNPHPDMLPRLQAVAEEELGLAFEGVSQEELGAQADVIITIT SAFEPLLMADWIKPGTHIACMGTDTKGKQEVDPVLFQRATVFADEIAQSISIGEAQHAVAQGLIAEGDITPV GAVINGTHAGRASAEEITLFDGTGVGLQDLAVASVAARIARERGLVTPVTL |
| 165 | MIIVPESAIANLMTADDAFKAVEAVFAAMSRGDAYNFPVIREAIGHADALYGFKSGFDRAGLNLGLKSGGY WPGNADKGLTNHQSTVFLFDADTGKCRAVVGGNLLTALRTAAAAAVSTAHLAREDARVLGIVGAGHQST FQLRQVAATRDFERVVAWNRSPEKLDRLAKVAAELGLPFEAVSLETLGAQADVIVTIVSAQAPTLLDAHV RPGTHIACMGTDTKGKQEVEAAILARATVFTDEVAQSVTIGEAQHAVGQGLIAKGDVNELGAVINGTHPG RRSGDEITVFDGTGVGLQDLAVAASVVERAIAEGVAVEVDF |
| 166 | MKDMPDKPLLIVGEDLCQQLVGRAEAFDAVQNVFAAMARGDAYNFPVIREAIGYADALYGFKSGFDRAG QVLGVKSGGYWPGNMDKGLTNHQSTVFLFDPDTGRLSALVGGNYLTAVRTAASSAVSIAHLARKDAKVL GMVGAGHQSTFQLRAAAEQRDFEKVVAWNPHPEMLPRLGEVAAEIGLEFEAVTQEELGAQADVIITITSA FEPLLMKDWIKPGTHLACMGTDTKGKQEVDAALVSHATVFTDEVAQSISIGEAQHAIADGTLTKVRITSIGS VINNDHPGRTSDDEITLFDGTGVGLQDLAVSVAARLADQSGKAERATL |
| 167 | MIVVSERAVAELITQADCLTAVEKVFASMARGSAYNFPVIREAIGHADALYGFKSGFDRESLALGLKSGGF WPGNSQKGLTNHQSTVFLFDADTGRCKAMVGGNLLTALRTAAASAVSIRHLARRDCRVLGMIGAGHQA AFQLRAALDQRCFERIVAWNFHPEMLGRLAEVAGERGIPFEEVSLDRLGAESDVIVTITSSFSPLLKAMQV RPGTHLACMGTDTKGKQEVEAELLAAATVFTDEVAQAVSIGESQHAIGRGLIRESDIIEIGAVITNAHPGRT SDDEITLFDGTGVGLQDLAVASAAVDLAIAKGAAVEVDF |
| 168 | MLAPVDPPTNKKGISIVSEDVCQQTVGRPEAFTAVENVFAAMARGDAYNFPVVREAIGHADALYGFKSGF DRAGMSLGVKSGGYWPGNAAKGLTNHQSTIILFDPDTGQIKSIVGGNYLTAVRTAASSAVSIAHLARKDA KVLGMIGAGHQSTFQLRAAVEQRDFEKVLAWNPHPKNLVRLATVCAELGLPFEAVEREQLCAEADVIITIT SAFEPLLRHEWIKPGTHIACMGTDTKGKQEVDPALLVAATLFTDEIAQSISIGEAQHAVASGALKAGDITSL GDVINGDHCGRSSAEEITLFDGTGVGLQDLAVASVAVQLADERKLSSKISL |
| 169 | MLIVPEREVAGLMTREAAFTAVEQVFAAMANGNAYNFPVVREAIGHEDALYGFKGGFDRTGLALGLKAG GYWPNNLEKRGMINHQSTVFLFDPDTGKARAMVGGNLLTALRTAAASSVSIRHLAREECKVIGMVGAGH QATFQLRAALEQRAFEKVIGWNMHPEMLPNIEKVAAEAGLPFEAVELDGLRAADVIISITSSFDAILTADHV APGTHIACMGTDTKGKQEVSPELLSKATVFTDEVAQSVSIGEAQHAVALGLIREADISQLGAVIDGTHPGR QSDEEITLFDGTGVGLQDLAVAAAVVDLAVEKGIAIEVDF |

FIG. 12N

| | |
|---|---|
| 170 | MIIVPENQIAGLMTPADCLVAVEEVFASMAKRSAYNFPVIREAIGYADALYGFKSGFDRSNLALGLKSGGF WPNNVQIGLANHQSSVFLFDADTGKCRAVVGGNLLTALRTAAASAISIKHLARKDAKVLGMIGAGHQSAF QLRAAVEQRSFEKILAWNLHPEMLSRLAEVAMELKLPFKIVDLERLGAESDVIISITSSFAPILKASQVRPGT HLACMGTDTKGKQEMEAELVAAATVFTDEVAQAVTIGECQHAIEKKLLSRDDITELGAVITGRHPGRSSP DEITLFDGTGVALQDLAVASAAVAHAVSRGTAIEVDF |
| 171 | MYIVPEKAIADLVTREASFDAVEKVFAAMAAGDAYNFPVVREAIGHEDALYGFKGGFDRAGLTLGLKAGG YWPNNLEKRGLINHQSTVFLFDPDTGKVKAMVGGNLLTALRTAAASSVSIKHLARQDAKVIGMIGAGHQA TFQLRAALEQRQFEKVIGWNYHPEMLPNIEKVAAEAGLPFEAVDLPGMTEADVIISITSAFAPSLMADHVS PGTHVACMGTDTKGKQEVEAEELLVKASVFTDEVAQSITIGEAQHAVAQGLIQESDVAQIGAVINGTNPGR TSDDQITLFDGTGVGLQDLAVAASVVEVAVEKGIAIEVDF |
| 172 | MYIVPEKAIADLVTREASFDAVEKVFAAMASGDAYNFPVVREAIGHEDALYGFKGGFDRAGLTLGLKAGG YWPNNLEKRGLINHQSTVFLFDPDTGKVKAMVGGNLLTALRTAAASSVSIKHLARQDAKVIGMIGAGHQA TFQLRAALEQRQFEKVIGWNYHPEMLPNIEKVAAEAGVPFEAVELEGMREADVIISITSAFAPSLMADHVS PGTHIACMGTDTKGKQEVEAELLVKSSVFTDEVAQSISIGEAQHAVAQGLIQESDVAQIGAVINGTNPGRT SDDQITLFDGTGVGLQDLAVAASVVEVAVEKGIAIEVDF |
| 173 | MIVVPEKEIAGLLTRADAFDAVEKVFASMSKGSAYNFPVIREAIGYEDALYGFKGGFDNTGMALGLKAGG YWPNNLEKHGEINHQSTVFLFDPDTGKVKAMVGGNLLTALRTAAASSVSIKHLARKDAKVMGMVGAGHQ ATFQLRAALEQREFEKVIGWNYHPEMLPNIEKVADEAGVPFEAVELDGLVEADVVISITSTFAPTIMANHIA PGTHIACMGTDTKGKQEVEAALLAQTTVFTDEVAQSISIGEAQHAIAAGLIQQSDVNELGAVINGTHPGRT SDDEITLFDGTGVGLQDLAVASSIVDLAVEKGIATIVEF |
| 174 | MIIVPEREIAGLMTRKAAFDAVEKVFAAMSAGDAYNFPVVREAIGHEDALYGFKGGFDQAGLTLGLKAGG YWPNNLEKRNLINHQSTVFLFDPDTGKAKAMVGGNLLTALRTAAASSVSIKHLARKDAKVIGMVGAGHQA TFQLRAALEQRDFEKVIGWNLHPEMLPNIEKVAEEAGLPFEAVDLSGMTEADVIISITSSFAPSLMADHVSS GTHIACMGTDTKGKKEVEAALLETATVFTDEVAQSISIGEAQHAIAEGLISQNDVNELGAVINGTHAGRIDE DQITLFDGTGVGLQDLAVAASVVDLAAAKGIAIEVDF |
| 175 | MLIVPEKDIADLMTRQAAFDAVEQVFAAMAAEDAYNFPVVREAIGHEDALYGFKGGFDRAGATLGLKAGG YWPHNLEKRDLINHQSTVFLFDPDTGKPAAMVGGNLLTALRTAAASSVSIKHLARPDAKVLGMIGAGHQA TFQLRAALEQRDFERVIGWNYHPDMLPNIAKVAEEAGLPFEAVDLPGMVDADVIISITSAFAPSLMADHVS PGTHIACMGTDTKGKQEVEAALFARATVFTDEVAQSVSIGEAQHAIAAELIEASDIHQIGAVINGAHPGRSG DTDITLFDGTGVGLQDLAVAARVVDLAEKKGIAIHVDF |
| 176 | MIIVPEKEIAALLGRAEAFEAVESVFAAMSSGVAYNFPVIREAIGHADALYGFKSGFDRSSLALGLKSGGY WPGNADNGLTNHQSTVFLFDADTGKARAVVGGNLLTALRTAAASAVSIKHLARKDAKVLGMIGAGHQSA FQMRAAVEQRSFEKVIGWNLHPEMLSRLEETAAELDLPFEAVDLDRLGAEADVIISITSSFDPILKVSQVTP GTHLACMGTDTKGKQEVEAELVAKATVFTDEVAQSSTIGECQNAVASGLISESDINEIGAVINGNHKGRTS VEEITLFDGTGVGLQDLAVASAVVDLAVEKGIAISVDF |
| 177 | MNDLSAQAPKAAQAGNTVTIVPEAEIAGLMTPEAAFDAVEATFAAMARGDAYNFPVIREAIGHADALYGF KSGFDRESLALGLKSGGYWPGNEARGLTNHQSTVILFDADTGRPSALVGGNLLTALRTAAASAVSIRYLA RQDAKVLGMIGAGHQSAFQMRAAVQQRSFEKVVGWNYHPEMLSRLADTAAELGLPFEAVTLEELGAQA DVIVTITSSFAPSLLDAHVRPGTHLACMGTDTKGKQEVEAGLLARARVFTDEVAQSVTLGEAQHAVAEGL TSADDITQLGAVINGTHPGRTSDQEITMFDGTGVGLQDLAVAAAVVRLAREQGVASQVVL |
| 178 | MIIVPEKEIAGLIGRQESFDAVESVFAAMAGGAAYNFPVIREAIGHADALYGFKSGFDRSSLALGLKSGGY WPGNMAKGLTNHQSTVFLFDADTGKAKAVVGGNLLTALRTAAASAVSIKHLARKDAKVLGMIGAGHQSA FQMRAAVEQRDFEKVLGWNHPEMLVRLEETANELGLPYESVDLARLGTEADVIISITSSFDPILMEEHVS PGTHIACMGTDTKGKQEVDVALVAKAKLFTDEVAQSATIGECQHAVASGIVSEDNIIEIGAVINGNHPGRTS QSDITLFDGTGVGLQDLAVASAAVDLAIQKGVAIEVDF |
| 179 | MIIVPERAIADLIGSAECFTAVEQVFAAMARKSAYNFPVVRESIGYADALYGFKSGFDRESLSLGLKSGGF WPKNAEKGLTNHQSTVFLFDADTGRCRAVVGGNLLTALRTAAASAISIKYLAREDAKILGIIGAGHQSTFQL RAAVQQRNFEKVVAWNYHPEMLTRLEDVAKEVGLPFEAVDLHRLGAEADVIISITSSFRPSLMASQVRPG THLACMGTDTKGKQEVDAKLVAASSLFTDEVAQAITIGECQHAIAAGLIAAEDILEIGAVITGEEKGRRSAD DITLFDGTGVGLQDLAVASAVVDLAVSKGVAIEVDF |
| 180 | MLVVAEKEIAGLMTPEAAFEAIEAVFASMARRKAYNFPVVREAIGHEDALYGFKGGFDASALTLGLKAGG YWPLNQKHNLINHQSTVFLFDPDTGRVSAAVGGNLLTALRTAAASAVSIKYLAPKGAKVLGMIGAGHQSA FQMRAAANVHRFEKVIGWNPHPEMLGRLADTAAELGLPFEAVDLPRLGAEADVIISITSSFSPLLMNEHVK GPTHIAAMGTDTKGKQELDPALVARARIFTDEVAQSVSIGECQHAIASKLIAEEQIGELGAVVAGDNPGRG DAEVTLFDGTGVGLQDLAVAKAVVELAKHKGVAQEVEI |
| 181 | MLIVPEREIANLMTREAAFEAVQKVFAAMASGDAYNFPVVREAIGHEDALYGFKGGFDRAGLTLGLKAGG YWPNNLEKHGMINHQSTVFLFDPDTGRATAMVGGNLLTALRTAAASSVSIAHLAREDARVIGMIGAGHQA KFQLRAALEQRSFEKVIGWNLHPEMLPNLEEVASEAGLPFEAVELDGIRDADVIISITSSFDAILTADQVSP GTHIACMGTDTKGKQEVDPALLARATVFTDEVAQSISIGEAQHAIASGLIAENDIAQLGSVINGTHPGRTSA EQITLFDGTGVGLQDLAVAAAVVDLAARNGSAIEVDF |

FIG. 12O

| | |
|---|---|
| 182 | MIIVPEKEIGALLGRNESYEAIEQVFAAMAAGDAYNFPVVREAIGHADALYGFKGGFDRAGMTLGLKAGG YWPNNLETHGLINHQSTVFLFDPDTGRVKAIVGGNLLTALRTAAASSVSINHLARKDAKVIGMVGAGHQA KFQLRAALEQREFEKVIGWNLHPDMLPNIEEVASEAGLPFEAVELPGMVEADVIITITSSFAPTLMSDHVSD GTHVACMGTDTVGKQEVGVDLINRATVFTDEVAQSITLGECQHAVASGSKTETDIRQIGEVINGTHPGRQ SDQEVTLFDGTGVGLQDLAVASAVVELAVEQGIAIEVDF |
| 183 | MIIVPEKEIAGLIGRQESFDAVESVFAAMAGGAAYNFPVIREAIGHADALYGFKSGFDRSSLALGLKSGGY WPGNMAKGLTNHQSTVFLFDADTGKAKAVVGGNLLTALRTAAASAVSIKHLARKDAKVLGMIGAGHQSA FQMRAAAEQRDFEKVLGWNLHPEMLVRLEETANELGLPYESVDLARLGAEADVIISITSSFDPILMEEHVS PGTHIACMGTDTKGKQEVDVALVAKAKLFTDEVAQSATIGECQHAVASGIVSEDNIIEIGAVINGNHPGRTS QSDITLFDGTGVGLQDLAVASAAVDLAIQKGVAIEVDF |
| 184 | MIIVPEHAIDGLLTEAECFGAVEQVFASMARRRAGNFPVVREAIGHADALYGFKSGFDRDSLALGLKAGG FWPGNAAKGLTNHQSTVFLFDADTGRCRAVVGGNLLTALRTAAACAISIRHLAREGARVLGMIGAGHQS AFQLRAALAQRPFERVLAWNLHPGMFGRMEAVARERGVPFEVVDLDRLGAEADVVVTITSSFAPILKAAQ VRPGTHVACMGTDTRGKQEVEAELLAAATVFTDEVAQSVSLGEAQHAVARGLLAADSIVEIGAVINGDHP GRVSDAEITVFDGTGVGLQDLAVAAVAVDRALAKGLATEVGF |
| 185 | MSDSKENHAPENHSHKNSLPVNKGVSVVSEAVCQEVMGRADAFTAVENVFSAMAKNTAYNFPVIREAIG HADALYGFKSGFDRDGMVLGLKSGGYWPGNVQKDLTNHQSTVILFDPDTGQLKSLVGGNYLTAVRTAA SSAVSIAHLARKDSKVLGMVGAGHQSTFQLRAAVEQREFEKIVCWNFHPEQIPKLAAVAEELGLPFESVT REELCAQADVIITITSAFEALIDKDWIKPGTHIACMGTDTVGKQEVDAKLLAVAKVFTDELAQSITLGEAQHA IAQKLIQQSDIVPIGEVINGTKTGRTSAEDITLFDGTGVGLQDLAVASVAAELAEAKGQVTYFNL |
| 186 | MSEANSVNSNEGLLIVSEDACKSVIDRPSAFIAVENVFASMSRGDAYNFPVIREAIGYADALYGFKSGFDR AGKSLGLKSGGYWPGNAAKGLTNHQSTIFLFNPDNGKLRALVGGNYLTAVRTAAASAVSIAHLARKDSKV LGMVGAGHQSTFQLRAALEQRSFEKVVAWNKNKDRLKNLQAVAEELGVPFEAVEREQLCSEADVIITITS AFEPLLMKEWIKPGTHIACMGTDTVGKQEVDVNLVASATVFTDEIAQSISLGEAQHAIKSGAIKESDITTLG DVINGDHPGRSSDDEITLFDGTGVGLQDLAVASAAAKLALEKGEAQHISL |
| 187 | MMNTQNEVSADGFVIVGEEICQKIISRADAFGAVEAVFAAMARGDAYNFPVVREAIGHADALYGFKGGFD RSGLSLGLKAGGYWPGNMDKGLTNHQSTVFLFDPDTGRLSALVGGNYLTALRTAASSSVSIAHLARNDS KVLGMVGAGHQSTFQLRAAVEQRAFEKVVAWNPHPDMLPRLGAVAEELGLEFEAVTQEELGAQADVIITI TSAFEPLMMADWVKPGTHIACMGTDTKGKQEVDPALFQRAAVFADEIAQSISIGEAQHAVGKGLIAEADIT PIGAVINGTHTGRSNAEEITLFDGTGVGLQDLAVASVAAKLAREQGLVTPITLG |
| 188 | METPSEALIQPHQILIISEDTCQKVIGRPEAFQAVESVFSSMAKGSAHNFPVVREAIGHAGALYGFKSGFD REGLVLGVKAGGYWPSNVVKGLTNHQSTVALFDPNTGQLKALVGGNYLTAIRTAASSAVSIAHLARKNAK VLGMIGAGFQSTFQLRAAIEQRDFEKVVAWNTHPEHLTRLADVCREHDLPFEAVSLQALGAQSDVIITITS ASEPLLQAGWIKPGTHLACMGTDTKGKQEIDHRLLAQATVFTDEIDQSISIGEAQHAVAARVLRAEQITPIG EVINGSHQGRQSEQEITLFDGTGVGLQDLAVASAAASIAEEARGLVQRVTL |
| 189 | MIIVPESAIGELVSLGDCVDAVEKTFVSMAERSAHNFPVVREAVGYADALFGFKSGFDREGLALGLKAGG FWPNNSDKGLTNHQSTVFLFDPETGRCRAVVGGNLLTALRTAAASAISIKHLARRDAKVLGMVGAGHQA SFQLRAAVQQRQFEKVVAWNYHPEMLPKLAAVAKELAVPFEAVDLERLGDEADVIITITSSFQPILKASQIR PGTHLACMGTDTKGKQEVDPALVAAATLFTDEIAQAISIGECQHAVAQGMIAPIDIAEIGAVINGQESGRTS PEEVTLFDGTGVGLQDLAVAQAAVELALARGIAVEVDF |
| 190 | MYIVPEQEIADLMTRKAAFDAVEKVFAAMAAGDAYNFPVVREAIGHEDALYGFKGGFDRAGLTLGLKAGG YWPNNLEKRGLINHQSTVFLFDPDTGKVKAMVGGNLLTALRTAAASSVSIKHLARKDAKVIGMIGAGHQA KFQLRAALEQREFEKVIGWNLHPEMLPNLQEVADEAGLPFEAVELEGLREADVIISVTSSFDAILKVDQVS PGTHIACMGTDTKGKQEVDPQLLVTADVFTDEIAQSVSIGEAQHAVAQGLIKEADVAQIGAVINGTNPGRT SDGQITLFDGTGVGLQDLAVAASVVERAVEAGIAIEVDF |
| 191 | MSKGLLIVGEDMCAEVVSSADAFTAVEAVFGAMAKGDAYNFPVIREAIGYADALYGFKSGFDKAGKTLGV KSGGYWPGNMDKGLTNHQSTIFLFDPDTGMLEALVGGNYLTAVRTAASSSVSIAHLARKDAKVLGMVGA GHQSTFQLRAAAEQRSFEKVVAWNPHPDMLPRLGAVAEELGLEFEAVTQEELGAQADVIITITSAFEPLL MKDWIKPGTHIACMGTDTKGKQEVDPELLASATVFADEIAQSITIGEAQHAVASGHLSESDITPIGAVINGT HAGRSSDQEITLFDGTGVGLQDLAVASVAAREAESRGKATRIAL |
| 192 | MYIVPESAIADILTRPDAFDAVEKVFAAMSAGDAYNFPVIREAIGHEEALYGFKGGFDGVGKSLGLKAGGY WPHNLEKRGIINHQSTVFLFDPDTGKVAAMVGGNLLTALRTAAASSVSIKHLARKDAKVMGMIGAGHQAK FQLRHALETHNFEKVIGWNYHPEMLPSLAEVAAEFDLPFEAASLKGMVEADVVISMTSSFNPIFGAAHISD GTHIACMGTDTVGKQECDTDLIVKATIFTDEVAQSVTLGETQHAVAAGLKSRDDIFELGAVINGTHAGRKS ENEITLFDGTGVGLQDLAVSASIVEIAKAKGIGMEVDF |
| 193 | MLIVPENKVAELINTAECFSAVENVFASMASKSANNFPVVREAIGHADALYGFKSGFDRETLALGVKSGGF WPGNAARGLVNHQSSIFLFDADTGRCRAVVGGNLITAIRTAAASAVSIKHLARKDAKTIGMIGAGHQSAFQ LRAALEQRPFDRVLGWNVEPKMLQRLRDVADERGVAFEAVGLDRLGAEADVIITISSFAPILKASHIRPGI HLACMGTDTRGKQEVEAELTASAILFTDEIVQAVTIGECQHAVAAGLVSQDEIAELGAVINGSDPGRRSDE EITLFDGTGVGLQDLAVATRVVDRAIETGAAIEVEY |

FIG. 12P

| | |
|---|---|
| 194 | MIIVPEAAIADLITRADAYRAVENVFASMSKGRAYNFPVIREAIGHADALYGFKSGFDRDGLALGMKSGGY WPRNADNGLTNHQSTVFLFDADTGKCRAVVGGNLLTALRTAAASAVSINHLARQDAKVLGMIGAGHQSA FQLRAAVEQRDFDRIVGWNYHPDMLPRLAKVAAEVGLPFEAVSLDELGAQADVIISITSAFAPSLMDADVR PGTHIACMGTDTKGKQELDPALLARATIFTDEIAQSVTIGEAQHAISAKLITESDISEIGAVINGTHPGRSDA EEITIFDGTGVGLQDLAVAAAVVDLAVAKGVATEVDF |
| 195 | MYIVPEKAIADLVTREASFDAVEKVFAAMAAGDAYNFPVVREAIGHEDALYGFKGGFDRAGLTLGLKAGG YWPNNLEKRGLINHQSTVFLFDPDTGKVKAMVGGNLLTALRTAAASSVSIKHLARQDAKVIGMIGAGHQA TFQLRAALEQRQFEKVIGWNYHPEMLPNIEKVAAEAGLPFEAVDLPGMAEADVIISITSAFAPSLMADHVS PGTHVACMGTDTKGKQEVEAEELLVKASVFTDEVAQSISIGEAQHAVAQGLIQESDVAQIGAVINGTNPGR TSDDQITLFDGTGVGLQDLAVAASVVEVAVEKGIAIEVDF |
| 196 | MWIVPESAIPGLVDEQSAFDAIEATFAAMSRGDAYNFPVVREALGEGRQYGFKSGLDRVGALLGVKAGG YFPGNAERGIPNHQSTVYLFDPDSGKPTAMVGGNLLTALRTAAASAISIKHLARADSEVLGMVGAGHQSA FQMRAAVRARGFKKVIGWNYHPEMLSRLADTAAELGLPFEAVSLEQLGAEADVIITITSSFDAIVQDAHIRP GTHLACMGTDTKGKQEVEAAILARASVFTDEVAQSVSIGEAQHAVAAGLLSEGAITEIGAVINGAHAGRAG AEEITVFDGTGVGLQDLAVASRAVELAVERGLAQQIAF |
| 197 | MKDMPETQGLVIVGEAECERLVGRKDAFDAVEAVFGAMAKGDAWNFPVVREAIGYADALYGFKSGFDK AGKVLGVKSGGYWPGNMDKELTNHQSTVFLFDPDTGQLAALVGGNYLTAVRTAASSAVSIAHLARKDAK VLGMVGAGHQSQFQLRAAAEQRDFEKVVAWNPHPEMLPKLGAVAEELGLPFEAVTQEQLGAQADVIITI TSAFEPLLMKDWIKPGTHIACMGTDTKGKQEVDAALVAAATVFTDEVAQSISIGEAQHAIAEGFLTEDRITP IGAVINGAHPGRSSDDEITLFDGTGVGLQDLAVASVAARLAEEEGSAQRVSL |
| 198 | MLVVAEKEIAGLMTPEAAFEAIEAVFASMARRKAYNFPVVREAIGHEDALYGFKGGFDASALVLGLKAGG YWPNNQKHNLINHQSTVFLFDPDTGRVSAAVGGNLLTALRTAAASAVSIKYLAPKGAKVLGMIGAGHQSA FQMRAAANVHRFEKVIGWNPHPEMLSRLADTAAELGLPFEAVELDRLGAEADVIVSITSSFSPLLMNEHV KGPTHIAAMGTDTKGKQELDPALVARARIFTDEVAQSVSIGECQHAIAAGLIREDQVGELGAVVAGDDPG RGDAEVTIFDGTGVGLQDLAVAQAVVELAKHKGVAQEVEI |
| 199 | MNTQTDGLLIVGEDLCEQLVGRSQAFDAVQSVFAAMASGGARNFPVIREALGYADALYGFKSGFDRDGQ VLGVKSGGYWPGNADKGLTNHQSTVFLFDPDTGQLSALVGGNYLTAVRTAASSAVSIAQLARKDAKVLG MVGAGHQSAFQLRAAAEQRDFEKVVAWNPHPDMLPRLAAVADEIGLEFEAVSQQELGAQADVIITITSAF EPLLMKDWIKPGTHLACMGTDTKGKMEVDPELVTSATVFTDEVAQSLTIGEAQHAAGTGALTESAITPIGA VINGDHPGRTGADEITLFDGTGVGLQDLAVASVAARLADEAGLAQRVAL |
| 200 | MIIVPEREIAALMTREAAYDAVETVFAAMAAEDAYNFPVVREAIGHEDALYGFKGGFDRAGKVLGLKAGG YWPNNLERRGIINHQSTVFLFDPDTGRAHAMVGGNLLTALRTAAASSVSINHLARADARVIGMVGAGHQA TFQLRAALAQRPFEKVIGWNLHPEMLPNLEKVADEAGLPFEAVDLPGLTEADVIVTITSSFAPSLMAAHVA PGTHLACMGTDTKGKQEVEAALLARATVFTDEVAQSVAIGEAQHAVAQGLIAEGDVTPIGAVINGTHPGR RSDEEITLFDGTGVGLQDLAVAARVVELAVEAGVAVEVDF |
| 201 | MLIVPEREIGALMTRASAFEAVEKVFAAMASGEAYNFPVIREAIGHEDALYGFKGGFDRAGLTLGLKAGGY WPNNLEKFRVINHQSTVFLFDPDTGKVAAMVGGNLLTALRTAAASSVSIAHLARRDAKVMGMVGAGHQA TFQLRAALEQRPFEKVIGWNLHPEMLPNIETVADEAGLPFEAVALEGMREADVIVSITSSFAPSLMAAHVS PGTHLACMGTDTRGKQEVEAALLAVATVFTDEVAQSVSIGEAQHAVAEGLISESDVHQIGAVINGSHPGR RSDEEITLFDGTGVGLQDLAVAAAVVDLAVEKGIAIEVDV |
| 202 | MLIVPEREIADLMTREAAFSAVEQVFASMAAGDAYNFPVVREAIGHEDALYGFKGGFDRAGLTLGLKAGG YWPHNLEKRGMINHQSTVFLFDPDTGKAKAMVGGNLLTALRTAAASSVSIRHLAREDAKVIGMVGAGHQ ATFQLRAALEQRDFDKVIGWNLHPEMLPNLEKVAAEAGLPFEAVELEGMRAADVIISITSSFDAILMEEHV APGTHIACMGTDTKGKQEVAPALLAKAAVFTDEVSQSVSIGEAQHAVAQGLIREADIAQLGAVINGAHPG RRSAEEITLFDGTGVGLQDLAVAAAVVDLAVEKGIAIEVDF |
| 203 | MLIVPEREIANLMTREAAFDAVEKVFAAMASGDAYNFPVVREAIGHEDALYGFKGGFDRAGLTLGLKAGG YWPNNLEKRGLINHQSTVFLFDPDTGMVKAMVGGNLLTALRTAAASSVSIKHLARKDAKVLGMIGAGHQA TFQLRAALEQRSFDKVIGWNYHPEMLPNIEKVASEAGVPFEAVDLPGMRAADVIISITSAFGPSLMADHVS PGTHVACMGTDTKGKQEVEAALLARAAVFTDEVAQSVSIGEAQHAVAQGLIQDSDIAQLGAVINGSHPGR ISDDQITLFDGTGVGLQDLAVAAAVVDLAVAQGIAIEVDF |
| 204 | MHIVSEATCREIMGRDDAFAAVEAIFSAMARGDAYNFPVIREAIGHADALYGFKSGFDRAGMVLGLKSGG YWPGNEKKGLTNHQSTVFLFDPDSGRPMAMVGGNHLTALRTAAASAVSIKHLARRDARVLGMVGAGFQ SAFQMRAAVAQRDFDKVVGWNLHPEMLGRLEATAAELGLPFEAVDLDRLGAEADVIITITSSFAPILSLAQ VRPGTHLACMGTDTKGKQEVDAALVAAATLFTDEVAQAAAIGECQHAVAAGLVDAAAITPIGAVIDGQHP GRSSPDEITLFDGTGVGLQDLAIASVAVAKAIDKGMAQSVAV |
| 205 | MIIVPERAIADLIGSAECFTAVEHVFAAMARKSAYNFPVIREAIGYADALYGFKSGFDRESLSLGLKSGGFW PKNAESGLTNHQSTVFLFDADTGRCRAVVGGNLLTALRTAAASAISIKYLAREDAKILGIIGAGHQSTFQLR AAVQQRNFEKVVAWNYHPEMLTRLEEVAREIGLPFEAVDLDRLGAEADVIISITSSFSPSLMASQVRPGTH LACMGTDTKGKQEVDAKLVAASSIFTDEVAQAITIGECQHAIADGMIAAEDILEIGAVITGDVKGRRSADDIT LFDGTGVGLQDLAVASAVVDLAVSKGVAIEVDF |

FIG. 12Q

| | |
|---|---|
| 206 | MQTQSPLLIVPEHLIADLISAQDCFAAVEQVFAAMARDTAYNFPVIREAIGHANALYGFKSGFDRESLALGL KSGGFWPRNADRGLTNHQSTIFLFDADTGRCRAVVGGNLLTALRTAAASAVSIRHLARPDARVLGMIGA GHQSTFQLRAALDQRDFDRVVGWNLNPADLDRLAKVADERGIPFQAVDLDQLGAQADVIITITSSFAPILQ AAQVRPGTHLACMGTDTKGKQEVEAALLGKASVFTDEVAQSVTIGEAQHAVAQGLIAPDDITQIGAVING DRPGRVSDDQITLFDGTGVGLQDLAVASAAVDLAVERGIAIAVQI |
| 207 | MIIVPEKEIATLLGRTESYDAVEQVFAAMAAGDAYNFPVVREAIGHANALYGFKGGFDRAGMTLGLKAGG YWPNNLETHGLINHQSTVFLFDPDTGRVRAVVGGNLLTALRTAAASSVSINHLARKDAKVIGMVGAGHQA TYQLRAALEQRSFEKVIGWNLHPEMLPNIANIASEAGLRFEAVELPGMVEADVIITITSSFAPILMSDHVSN GTHVACMGTDTVGKQEVGVDLITRATVFTDEVAQSITLGECQHVVAEGSKTEADIRQIGEVINGTHPGRQ TDEEVTLFDGTGVGLQDLAVAGAVVDLAVERGIAIEVDF |
| 208 | MKDMPETQGLVIVGEAECERLVGRKDAFDAVEAVFGAMAKGDAWNFPVVREAIGYADALYGFKSGFDK AGKVLGVKSGGYWPGNMDKELTNHQSTVFLFDPDTGQLAALVGGNYLTAVRTAASSAVSIAHLARKDAK VLGMVGAGHQSQFQLRAAAEQRDFEKVVAWNPHPEMLPKLGAVAEELGLPFEAVTQEQLGAQADVIITI TSAFEPLLMKDWIKPGTHIACMGTDTKGKQEVDAALVAAATVFTDEVAQSISIGEAQHAIAEGFLTEDRITP IGAVINGAHPGRSSDDEITLFDGTGVGLQDLAVASVAARLAEEEGSAQRVSL |
| 209 | MWIVPEAKIAGLMDRATCFAAIEGVFGAMARGDAYNFPVIREAIGHADALYGFKSGFDRAGLALGLKSGG YWPGNEAKGLTNHQSTVVLFDPDTGRVKALVGGNLLTALRTAAASAVSIKHLARPDAKVLGMVGAGHQS AFQMRAAVEQRAFEKVVGWNFHPEMLDRLAGVAAELGLPFEAVSLDELGAQSDVIITITSSHKPILRSAQV KAGTHIACMGTDTKGKQEVDDLLVARATVFTDEVAQAISIGECQHAIASGLMAEAEIAELGAVINGSHKGR TSAEEVTLFDGTGVGLQDLAVAAAVVELAIAKGIAIEVDF |
| 210 | MLIVPEREISNLMTRDAAFEAVEKAFAAMASEDAYNFPVIREAIGHEDALYGFKGGFDRAGLTLGLKAGGY WPHNLEKRGEINHQSTVFLFDPDTGKAKAMVGGNLLTALRTAAASSVSIKHLARKDAKVLGMIGAGHQAT FQLRAALETHRFKKVIGWNFHPDMLPNIEKVANEAGVPFEAVDLPSMRDADVIISITSAFAPSLMADHVSP GTHVACMGTDTKGKQEVEAALLARASVFTDEVAQSISIGEAQHAIAEGLIKESDVAQLGAVINGTHKGRAS DDEITLFDGTGVGLQDLAVAASVVDLAVAKGIAIEVDF |
| 211 | MLVVPEKQIAGLMTPEAAFEAIEAVFASMARRKARNFPVVREAIGHEDALYGFKGGFDGVALVLGLKAGG YWPLNQKHGLINHQSTVFLFDPDTGRVAAAVGGNLLTALRTAAASAVSIKYLAPKGAKVLGMIGAGHQST FQMRAAANVHRFEKVIGWNPHPEMLSRLADTATELGLPFEAVELDRLGTEADVIISITSSFSALLMDQHVK GPTHIAAMGTDTKGKQELDPALVARARIYTDEIAQSVSIGECQHAIAAGLIAQEAIRELGAVVAGRGPGRD GAEVTLFDGTGVGLQDLAVAAAVVELAKHKGVAQEVEI |
| 212 | MFIVPEKEIAGLVSADQCFEAVEAVFAAMARGDAYNFPVIREAIGHAEALYGFKSGFDRAGAVLGLKSGG YWPGNAAKGLTNHQSTVVLFDPDSGRPAALVGGNLLTALRTAAASAVSIRYLARSDARVLGVLGAGHQS AFQLRAAVAQRRFEKIVGWNYHPEMLPRLAETAAELGLPFEAVSLEDFGAQADVIVTISSSFSAQLMDAH VRPGTHLACMGTDTTGKQEIDPAIFVRARVFADEIAQSVEIGEAQHAVAAGLIAAEDIVEIGAVINGTAPGR QSDDEITVFDGTGVGLQDLAVAARAVAAARARGVAVEVDL |
| 213 | MFIVPEKEIAALVTRKDNFDAVEQVFASMAGGSAYNFPVIREAIGHADALYGFKSGFDRAALNLGLKSGGY WPGNAEKGLTNHQSTVFLFDADTGKCRAVVGGNLLTALRTAAAAAVSVAHLARKDSKVLGMIGAGHQAT FQLQAVAEQRNFEKVVAWNRTSEKLASLQNVADDLGLPFESVSLDELGAQADVIVTIVSSQAAILNDAQV KPGTHIACMGTDTKGKQEVDANLVARATVFTDEIAQSISIGEAQHAIADGSLKQADISEIGAVINGDHPGRT SDDEVTLFDGTGVGLQDLAVASKVVDLAIEKGIAIEVDF |
| 214 | MYIVPEKEIAGLMTREAAFDAVEKVFAAMASGDAYNFPVVREAIGHEDALYGFKGGFDRAGLTLGLKAGG YWPNNLEKRGLINHQSTVFLFDPDTGKAKAMVGGNLLTALRTAAASSVSIKHLARKDAKVIGMIGAGHQA KFQLRAALEQRQFEKVIGWNLHPDMLPNLQEVADEAGLPFEAVELDGMREADVIISITSSFDAILNTAQVS PGTHIACMGTDTKGKQEVDPQLLVAADVFTDEVAQSISIGETQHAVAQGLIQEADVAQIGAVINGTNPGRT SGDQITLFDGTGVGLQDLAVAASVVDLAVEQGIAIEVDF |
| 215 | MMNTHAEATADGFVIVGEDICEKVISRADAFDAVEAVFAAMARGDAYNFPVVREAIGHADALYGFKGGFD RTGLSLGLKAGGYWPGNMARGLTNHQSTVFLFDPDTGRLSALVGGNYLTALRTAASSSVSIAHLAREDS KVLGMVGAGHQSTFQLRAAVEQRDFEKVVAWNPHPEMLPRLGAVAEELGLAFEAVSPEDLGAQADVIITI TSAFEPLIMADWIRPGTHIACMGTDTKGKQEVDPALFSRATVFADEVAQSISIGEAQHAVGQGVIAESDIT PVGAVINGTHGGRGSDEEITLFDGTGVGLQDLAVAAVAARLAREQGLVTPVTF |
| 216 | MLIVPEREIANLMTRAAAFDAVEQVFAAMAAGDAYNFPVVREAIGHEDALYGFKGGFDRAGLTLGLKAGG YWPNNLEKRNLINHQSTVFLFDPDTGRARAMVGGNLLTALRTAAASSVSIKHLARKDARVIGMVGAGHQ ATFQLRAALEQRDFDKVIGWNYHPEMLPNIEKIAREAGVPFQAVDLPGMVEADVIISITSAFSPSLMADHV APGCHLACMGTDTKGKQEVEAALLARATVFTDEVAQSVSIGEAQHAVAEGLIAESDVHQLGAVINGTHAG RVSDDQITLFDGTGVGLQDLAVAAAVVDLAVAQGIAIEVDF |
| 217 | MIIVPEKEIGALLGRKESYSAVEQVFAAMASGDAYNFPVVREAIGHADALYGFKGGFDRAGMTLGLKAGG YWPNNLETHGLINHQSTVFLFDPDTGRVKAIVGGNLLTALRTAAASSVSINHLARKDAKVIGMVGAGHQA TFQLRAALEQRDFEKVIGWNPHPEMLPNIEKVANEAGLPFEAVELPGLTEADVIVTITSSFEPTLLSEHVSD GTHVACMGTDTVGKQEVGADLVIRASVFTDEVAQAITLGESQHAVAAGDKAEADIHQIGAVINGTHAGRN SDDEVTLFDGTGVGLQDLAVASAVVDLAVKQGIAIEVDF |

FIG. 12R

| 218 | MLIVPEREIGNLMTRAAAFDAVEGVFAAMASKNAYNFPVVREAIGYEDALYGFKGGFDRAGKTLGLKAGG YWPNNLEKFDLINHQSTVFLFDPDTGRVKAIVGGNLLTALRTAAASSVSIKHLAREDAKVLGMIGAGHQAT FQLRAALEQRSFEKVVGWNYHPEMLPNIEKVAAEAGLPFEAAQLDRLGQEADVVISITSAFAPSLMADHV SPGTHIACMGTDTKGKQELDAALLPRATVFTDEVAQSVSIGEAQHAVAQGLIAQSDVQQIGAVINGTHPG RTSAEEITLFDGTGVGLQDLAVAASVVDLAVQQGIAIEVDF |
| --- | --- |
| 219 | MSEANSVHSDEGLLIVSEDACKSVIDRPSFAFTAVENVFASMSRGDAYNFPVIREAIGYADALYGFKSGFD RAGKSLGLKSGGYWPGNADKGLTNHQSTIFLFNPDNGKLRALVGGNYLTAVRTAAASAVSIAHLARKDS KVLGMVGAGHQSTFQLRAALEQRNFEKVVAWNNNKDRLKNLQAVAEEELGVPFESVEREQLCSEADVIITI TSAFEPLLMKEWIKPGTHIACMGTDTVGKQEVDVNLISAATVFTDEIAQSISLGEAQHAIKSSAIKESDITTL GDVINGEHPGRSSDDEITLFDGTGVGLQDLAVASAAAK |
| 220 | MLVVPERLIAGLMGPDEAFEAVAEVFRQTAGGAARNFPVVREALGGGRQYGFKSGMGPGALGVKAGGY FPGNAARGITNHQSVVTLFDPETGRPEAMIGGNLLTALRTAAAAAVSIDALARPGARVLGIVGAGHQAAF QLRAAARVRRFERVIAWNRTPERLAGLAAVAEELGLPFEAVPLAGMREAEVIVTITSSPAYALAAAHVSPG THLACMGTDTIGKQEVEPALLGAARVFTDEPAQSVTLGEAQHAVAQGLLDPARIVPLGAVLTGEAPGRED PDQITLYDGTGVGLQDLAVAARVLALAKARGLAIPVEI |
| 221 | MFVVPESEIAGLVSPAQCFEAVEAVFSAMARDEAYNFPVIREAIGHADALYGFKSGFDRAGKVLGLKSGG YWPGNVEKGLTNHQSTVVLFDPDTGRPAALVGGNLLTALRTAAASAVSIRHLARCDSRVLGLLGAGHQS AFQMRAAVAERPFEKVIGWNYHPEMLPRLAETAVELGLPFEAVSLEDLGAQADVIVTISSSVAAQLLDAH VRPGTHLACMGTDTRGKQEIDAAIFARARVFTDEVAQSVEIGEAQHAVAAGLIGAGDIVQIGAVINGTVPG RQSEDDITLFDGTGVGLQDLAVAARAVAAARAKGVAVEVDL |
| 222 | MIIVPESAIGELVSLEDCVDAVEKVFVSMAERSAHNFPVVREAIGYADALFGFKSGFDRKGLALGLKAGGF WPNNADKGLTNHQSTVFLFDPETGRCRAVVGGNLLTALRTAAASAVSIKHLARNDAKVLGMVGAGHQAS FQLRAAVQQRQFEKVVAWNYHPDMLPKLAAVAEELGIPFEAVNLDRLGAEADVIITITSSFQPILKASQIKP GTHLACMGTDTKGKQEVDVALVAGATLFTDEIAQAISIGECQHAIAQGMIAPIDIAEIGAVINGQKPGRTSP DEITLFDGTGVGLQDLAVAQAAVGLALARGTAVEVDF |
| 223 | MIIVPEKEIAGLIGRQESFDAVESVFAAMAGGAAYNFPVIREAIGHADALYGFKSGFDRSSLALGLKSGGY WPGNMAKGLTNHQSTVFLFDADTGKAKAVVGGNLLTALRTAAASAVSIKHLARKDAKVLGMIGAGHQSA FQMRAAAEQRDFEKVLGWNLHPEMLVRLEETANELGLPYESVDLARLGAEADVIISITSSFDPILMEEHVS PGTHIACMGTDTKGKQEVDVALVAKAKLFTDEVAQSATIGECQHAVASGIVSEDNIIEIGAVINGNHPGRTS QSDITLFDGTGVGLQDLAVASAAVDLAIQKGVAIEVDF |
| 224 | MYVVAEKDIAGLMTPEAAFEAIEAVFASMARRQAYNFPVVREAIGHADALYGFKGGFDGAGLALGLKAGG YWPHNQERGLINHQSTVFLFDPDSGRVSAAVGGNLLTALRTAAASAVSIKYLAPKGAKVLGMIGAGHQSA FQMRAAARVHPFEKVIGWNPHPEMLGRLSDTAAELGLPFEAVELERLGEEADVIISITSSFGPLLMDDHVK GPTHIAAMGTDTKGKQELDPGLVARARLFTDEIAQSVSIGEYQHAVAQGLITQDRIGELGAVVTGDDAGR GDAEVTIFDGTGVGLQDLAVAAKVVELAKQKGIAQQVEV |
| 225 | MYIVPERAIADLMTRDAAFDAVEKVFAAMAAGDAYNFPVVREAIGHEDALYGFKGGFDRAGLSLGLKAGG YWPNNLEKRGLINHQSTVFLFDPDTGKVRAMVGGNLLTALRTAAASSVSIKHLAREDAKVIGMIGAGHQA KFQLRAALEQRDFDKVIGWNLHPEMLPNLEEIATEAGLPFEAVELDGLKEADVIISITSSFDAILKADQVSP GTHIACMGTDTKGKQEVDPQLLVRATVFTDEVAQSTSIGEAQHAVAQGLIAEADVAQLGAVINGAHPGRS SAEQITLFDGTGVGLQDLAVAASVVELVVKKGIAIEVDF |
| 226 | MIIVPEAAIANLVTPEASFAAVEKVFASMAAKSAYNFPVIREAIGHADALYGFKSGFDRAALNLGLKSGGY WPGNADKGLTNHQSTVFLFDADTGRCRAVVGGNLLTALRTAAAAAVSVAHLARRDAKVLGIVGAGHQAA FQLRAVAAQRPFERVVAWNRSPEKLSGLREVAEGLGLAFETVSLDDLGAQADVIVTITSSFDAILGADQV RPGTHLACMGTDTKGKQEVDAALLGRATVFTDEIAQSTTIGEAQHAIADLTLRLEDIVELGAVINGDHPGR SSDDEITLFDGTGVGLQDLAVAAAVVDLAVERGVATEVEF |
| 227 | MIIVPEREIAGLLGRADAYMAVEAVFAAMASGDARNFPVIREAIGHADALYGFKSGFDRAGLALGLKSGGY WPGNAAKGLTNHQSSVFLFDADTGKCRAVVGGNLLTALRTAAAAAVSINHLARVDARVLGIVGAGHQSV FQLRAALEQRDFTRVVAWNRDPAKLARLSDVAAEHGLPFAAVSLAELGAAADVIITIVSAHEPLLMDAHIR PGTHISCMGTDTKGKQEIDAAIFARASVFTDEIAQSTSIGEAQHAVAAGIISADRITALGAVINGTHQGRTSA DEITIFDGTGVGLQDLAVASAVVDLAVTQGVATIVDF |
| 228 | MIIVPESAIGELVSLEDCVDAVEKVFVSMAERSAHNFPVVREAIGYQDALFGFKSGFDREGLALGLKAGGF WPNNADKRLTNHQSTVFLFDPETGRCRAVVGGNLLTALRTAAASAVSIKHLARRDAKVLGMVGAGHQAS FQLRAAMQQRPFEKVVAWNYHPEMLPKLAAVAQELAVPFEAVDLDRLGGEADVIITITSSFQPILKALQIK PGTHMACMGTDTKGKQEVDAALVAEATLFTDEIAQAISIGECQHAVARGMIAPIDIVEIGAVINGQQPGRT SPDQITLFDGTGVGLQDLAVAQAAVGLALARGMAVEVDF |
| 229 | MIIVPENRIDGLLTEADCFTAVEKVFASMARRTAGNFPVVREAIGHADALYGFKSGFDRESLALGLKAGGF WPGNAAKGLTNHQSTVFLFDADTGRCRAVVGGNLLTALRTAAASAISIKHLARKDARVLGMIGAGHQSAF QLRAALAQRPFERVLAWNLHPGMFGRMEAVAREHGVPFEVAELDRLGAEADAIVTITSSFAPILKASHVK PGTHIACMGTDTKGKQEVEAELLAAATVFTDEVAQSVSIGEAQHAIGRGLLTEGAIVEIGAVINGDHPGRT SDEEITLFDGTGVGLQDLAVASAAVDLAVAKGLAVEVEF |

FIG. 12S

| | |
|---|---|
| 230 | MIIVPETEIAGLVTPADCFRAVEGVFASMADKSAYNFPVIREAIGHADALYGFKSGFDRKGLALGLKAGGF WPNNVHRGLTNHQSTVFLFDADTGKCRAVVGGNLLTALRTAAASAISIKYLARKDAKVLGMIGAGHQATF QLRAALAQRSFERIVGWNLHPDMLSRLEEVAKEEGLPFEAVDLDRLGAEADVIISITSSFAPMLKASQVRA GTHLACMGTDTKGKQEVEAEILAAAAVFTDEVAQAVTIGESQHAIERGLIREEAIVEIGAVINGTHPGRTSA DQITLFDGTGVGLQDLAVASAAVELALAKGVAIEVDF |
| 231 | MIIVPERDIAGLIGPADCFVAVEGVFAAMARRTARNFPVVREALGHADALYGFKSGFDGESLALGLKSGG FWPGNMARGLTNHQSAVFLFDADTGQCRAIVGGNRLTALRTAAASAISIKYLARQDARTLGIIGAGHQSTF QLEAALEQRAFEKIVGWNVEPEMLSKLEEVAARRGLPFERVDLDGLGAQADVIITITSSFAPILKVAQVRP GTHIACMGTDTVGKQEVEAELVARASVFTDEVAQAVTLGESQHAVAAGLVDAGSIVEIGQVVTGGHAGR TTPEEITLFDGTGVGLQDLAVASAIVDLAVRKGIATEVEF |
| 232 | MLIVPEREIANLMTRAAAFDAVEQVFAAMAAGDAYNFPVVREAIGHEDALYGFKGGFDRAGLTLGLKAGG YWPNNLEKRNLINHQSTVFLFDPDTGRARAMVGGNLLTALRTAAASSVSIKHLARKDARVIGMVGAGHQ ATFQLRAALEQRDFDKVIGWNYHPEMLPNIEKIAREAGVPFQAVDLPGMVEADVIISITSAFSPSLMADHV APGCHLACMGTDTKGKQEVEAALLARATVFTDEVAQSVSIGEAQHAVAEGLIAESDVHQLGAVINGTHAG RVSDDQITLFDGTGVGLQDLAVAAAVVDLAVAQGIAIEVDF |
| 233 | MIIVPEHAIDGLLTEAECFTAVEQVFASMARRRAGNFPVVREAIGHADALYGFKSGFDRDSLALGLKAGGF WPGNAAKGLTNHQSTVFLFDADTGRCRAVVGGNLLTALRTAAACAISVRHLARKDARVLGMIGAGHQSA FQLRAALAQRPFEGVLAWNLHPGMFGRMEAVAREHGVPFEAVDLDRLGSEADVVVTITSSFAPILKAAQ VRPGTHLACMGTDTRGKQEVEAELLAGATVFTDEVAQSVSIGEAQHAVARGLLAADSIVEIGAVINGDHP GRVSESEITLFDGTGVGLQDLAVAAVAVDRAVAKGLATEVDV |
| 234 | MIIVPEHAIDGLLTEAECFTAVEQVFASMARRRAGNFPVVREAIGHADALYGFKSGFDRDSLALGLKAGGF WPGNAAKGLTNHQSTVFLFDADTGRCRAVVGGNLLTALRTAAACAISVRHLARKDARVLGMIGAGHQSA FQLRAALAQRPFDRVLAWNLHPGMFGRMEAVAREHGVPFEAVDLDRLGSEADVVVTITSSFAPILKAAQ VRPGTHLACMGTDTRGKQEVEAELLAGATVFTDEVAQSVSIGEAQHAVARGLLAADAIVEIGAVINGDHP GRVSESEITLFDGTGVGLQDLAVAAVAVDRAVAKGLATEVDF |
| 235 | MLVVAEKEIAGLMTPEAAFEAIEAVFASMARRKAYNFPVVREAIGHEDALYGFKGGFDAAALTLGLKAGG YWPNNQKHGLINHQSTVFLFDPDTGRVSAAVGGNLLTALRTAAASAVSIKHLAPKGAKVLGMIGAGHQSA FQMRAAANVHRFEKVIGWNPHPEMLSRLADTAAELGLPFEAVELDRLGAEADVIISITSSFSPLLLNEHVK GPTHIAAMGTDTKGKQELDPALVARARVFTDEVAQSVSIGECQHAIASGLIREDQIGELGAVVAGDDPGR GDAEVTIFDGTGVGLQDLAVAQKVLEIAKQEGLAQEVEI |
| 236 | MFIVPERDIADLMTREAAFDAVEKVFAAMASGDAYNFPVVREAIGHEDALYGFKGGFDRAGLTLGLKAGG YWPNNLEKRGIINHQSTVFLFDPDTGKAKAMVGGNLLTALRTAAASSVSIKHLARKDAKVIGMVGAGHQA KFQLRAALEQRDFEKVIGWNFHPEMLPNLEEVASEAGLPFEAVALEGLAEADVIISITSSFDAILHADHVAP GTHIACMGTDTKGKQEVETALLGKATVFTDEVAQSISIGEAQHAIESQILRAEDITQVGAVINGTHPGRISD DEITLFDGTGVGLQDLAVAAAVVDLAVAKGLAIEVDF |
| 237 | MLVVAEKEIAGLMTPEAAFEAIEAIFASMARRKAYNFPVVREAIGHEDALYGFKGGFDASALVLGLKAGGY WPNNQKHNLINHQSTVFLFDPDTGRVTAAVGGNLLTALRTAAASAVSIKYLAPKGAKVLGMIGAGHQSAF QMRAAANVHPFEKVIGWNPHPEMLSRLADTAAELGLPFEAVELDRLGTEADVIISITSSFSPLLMDQHVKG PTHIAAMGTDTKGKQELDPALVARARIFTDEVAQSVSIGECQHAIASGLIREDQIGELGAVVAGDHPGRVD AEVTLFDGTGVGLQDLAVAQKVLEIAKEKGLAQEVEI |
| 238 | MLIVPERDIADLMTRAAAFEAVEQVFAAMASKDAYNFPVVREAIGHEDALYGFKGGFDRAGLTLGLKAGG YWPNNLEKRGLINHQSTVFLFDPDTGMVRAMVGGNLLTALRTAAASSVSIKHLARKDAKVLGMIGAGHQ ATFQLRAALEQRDFEKVIGWNYHPEMLPNIATVAEEAGVPFEAVDLEGMREADVIVSITSAFAPSLLADHV SEGTHVACMGTDTKGKQEVEARLLAKATVFTDEVAQSISIGEAQHAVAEGLIRAEDVAELGAVINGTHPG RSSDDQITLFDGTGVGLQDLAVAASVVDLAVEKGVAIEVDF |
| 239 | MGGMQTDAHKLTIVPEGMIADLLTRQAAFDAVEKVFASMASGEARNFPVVRAALGHEDALYGFKGGFDR AGGVLGLKAGGYWPHNLERRGLINHQSTVLLFDPDSGRVNAMVGGNLLTALRTAAASSVSIKHLARDDA KTLGMIGAGHQSAFQLRAALEIRDFEKVIGWNLHPDKLGSLAQVAKSMGVPFEAVPLERMTEADVIISITS SFNAVLMADHVSPGTHVACMGTDTIGKQEVEVALLAKASVFTDEVAQSVSIGEAQHAISMGLITETDVKQI GAVISGSHVGRQSDDEITLFDGTGVGLQDLAVADSIVKAAVAQGLATVVQL |
| 240 | MQTQSPLLIVPEHLIADLISAQDCFAAVEQVFAAMARDTAYNFPVIREAIGHADALYGFKSGFDRESLALGL KSGGFWPRNADRGLTNHQSTIFLFDADTGRCRAVVGGNLLTALRTAAASAVSIRHLARWDARVLGMIGA GHQSIFQLRAALDQRDFDRVVGWNLNPADLDRLAKVADERGIPFQAVDLDQLGAQADVIITITSSFAPILQ AAQVRPGTHLACMGTDTKGKQEVEAALLGKASVFTDEVAQSVTIGEAQHAVAQGLIAPHDIIQIGAVINGD RPGRVSDDQITLFDGTGVGLQDLAVASAAVDLAVERGIAIAVQI |
| 241 | MLIVPEREIANLMTRQAAFEAVEKVFAAMAAGDAYNFPVVREAIGHEDALYGFKGGFDRAGLTLGLKAGG YWPNNLEKRGLINHQSTVFLFDPDTGKVKAMVGGNLLTALRTAAASSVSIKHLARPDARVLGMVGAGHQ ATFQLRAALEQRSFDKVIGWNYHPEMLPNIQKVADEAGVPFETVELNGMRQADVIISITSAFAPSLMADHV APGCHVACMGTDTKGKQEVEAALLARATVFTDEVAQSVQIGEAQHAVAQGLIAESDVTQIGAVINGTHPG RDSDDQITLFDGTGVGLQDLAVAASVVDLAVQQGIAITVDF |

FIG. 12T

| | |
|---|---|
| 242 | MKDMPETQGLVIVGEAECERLVGRKDAFDAVEAVFGAMAKGDAWNFPVVREAIGYADALYGFKSGFDK<br>AGKVLGVKSGGYWPGNMDKGLTNHQSTVFLFDPDTGQLAALVGGNYLTAVRTAASSAVSIAHLARKDAK<br>VLGMVGAGHQSQFQLRAAAEQRDFEKVVAWNPHPEMLPKLGAVAEELGLPFEAVTQEQLGAQADVIITI<br>TSAFEPLLMKDWIKPGTHIACMGTDTKGKQEVDAALVAATTVFTDEVAQSISIGEAQHAIAEGSLTEDRITP<br>IGAVINGAHPGRSSDDEITLFDGTGVGLQDLAVASVAARLAEEEGSAKRVSL |
| 243 | MDTSSEALTQPHQILIVSEDACQKVIGRHEAFQAVESVFSSMAKGSAYNFPVVREAIGHANALYGFKSGF<br>DREGLVLGVKAGGYWPGNVVQGRTNHQSIVALFDPDTGQLKALVSGNYLTAIRTAASSAVSIAHLARKNA<br>KVLGMIGAGFQSTFQLHAALEQRDFEKVVAWNTHPEHLTRLADVCREHNLPFEAVSLQALGSQSDVIITIT<br>SASEPLLQAAWVKPGTHLACMGTDTKGKQEIDHRILAQATVFTDEIDQSISIGEAQHAVTARILSAEQITPIG<br>EVINGLHQGRQSEQEITLFDGTGVGLQDLAVASAAASLAEVRGLAQRVTL |
| 244 | MIIVPEHAIDGLLTEAECFTAVEQVFASMARRRAGNFPVVREAIGHADALYGFKSGFDRDSLALGLKAGGF<br>WPGNAAKGLTNHQSTVFLFDADTGRCRAVVGGNLLTALRTAAACAISVRHLARKDARVLGMIGAGHQSA<br>FQLRAALAQRPFERVLAWNLHPGMFGRMEAVAREHGVPFEAVDLDRLGAEADVVVTITSSFAPILKAAQV<br>RPGTHLACMGTDTRGKQEVEAELLAGATVFTDEVAQSVSIGEAQHAVTRGLLAADSIVEIGAVINGDHPG<br>RVSESEITLFDGTGVGLQDLAVAAVAVDRAVAKGLATEVDV |
| 245 | MGLDGAMTDSAVTIVPEGEIAGLITPQIAFDAVEATFAAMSRKSAYNFPVIRESIGHADALYGFKSGFDRD<br>SLALGLKSGGYWPGNEAKGLTNHQSTVILFDADTGKVKALVGGNLLTALRTAAASAVSIKHLAREDAKVL<br>GMIGAGHQSAFQMRAAVAQRNFEKVVGWNYHPEMLSRLEDTATELGLPFEAVSLEELGAQSDVIISITSS<br>FAPSLLDAHVKPGTHIAAMGTDTKGKQEIDAPILARATVFTDEIAQSITIGEAQHAIADGSLTEGQITEIGAVI<br>NGDHAGRTSADEITVFDGTGVGLQDLAVARVAVDLAQAKGVASKVDF |
| 246 | MLIVPEREIADLMTRSAAFDAVEKVFAAMASGDAYNFPVIREAIGHADALYGFKGGFDRAGLTLGLKAGG<br>YWPNNLDQHGIINHQSTVFLFDPDTGRVRAMVGGNLLTALRTAAASSVSIRHLARDDAKVIGMIGAGHQA<br>KFQLRAALEQRDFEKVIGWNLHPEMLPNLEEVAAEAGLPFEAVELDGIREADVIISITSSFDAILMADQVSP<br>GTHIACMGTDTKGKQEVDPALLARATVFTDEVAQSVSIGEAQHAVAAGLIAESDITQIGAVINGTHPGRAS<br>AEEITLFDGTGVGLQDLAVAAAVVDLAVQNGVAVEVDF |
| 247 | MIIIPERDIAGLVSAADCFVAVEQTFASMAKQSARNFPVIREALGHADALYGFKSGFDRESLALGLKSGGY<br>WPNNAQKGLTNHQSTVFLFDADTGRCRAIVGGNLLTALRTAAASAVSIKHLARPDSKVLGIVGAGHQSTF<br>QLRAALEQRPFEKVLAWNKTPEKLERLASVAREKGLPFQSVSLEQLCGEADVVITITSSFSPVIAEGLIRPG<br>THLACMGTDTKGKQEVAPEIVAGSTVFTDEVVQSTSIGEAQHAFRLGMIDAAAIIPIGVVVNGDHPGRRSA<br>EEITLFDGTGVGLQDLAVASAAVDLALARGTAIEVDA |
| 248 | MIIVPEREIAWLVSDADCFAAVERVFASMAKKSASNLPVVREAIGHLDAIYGVKSGIDREGLVLGLKSGGF<br>WPNNVSRGLTNHQSTIMLFNADTGECRAVVGANLLTALRTAAASAISIKYLSRPDSKVLGIIGAGHQSTFQ<br>LKAALQQRAFEKVVGWNIVPQHLARLETVAAEHGLPFERVDLDTLGAQADVIITITSSFDPILRAGQVRPGT<br>HLACMGTDTKGKQEVDARLLANATVFTDEVAQAVTMGETQHAVAEGLVDASAIIAIGAVINGDHSGRVSA<br>EEITLFDGTGVALQDLAVASVAVERAVATGVATTIAF |
| 249 | MIIVPEREIADLMTRAAAFDAVEKVFAAMAADDAYNFPVVREAIGHEDALYGFKGGFDRAGKVLGLKAGG<br>YWPHNLEKRGEINHQSTVFLFDPDTGKAKAMIGGNLLTALRTAAASSVSIKHLAREDAKVMGMIGAGHQA<br>TFQLRAALEQRSFEKVIGWNYHPDMLPNIAKIAEEAGLPFEAVDLPGMAEADVIISITSAFAPSLMADHVSA<br>GTHIACMGTDTKGKQEVEAALLAKATVFTDEVAQSVSIGEAQHAVAEGLIAESDVHQLGAVINGTHPGRV<br>SADDITLFDGTGVGLQDLAVAASVVDLAIEKGIAIEVDF |
| 250 | MTTPASGAGNPISIVSEAVCQQIVGRPEAFKAVENVFAAMARGDAYNFPVVREAIGHADALYGFKSGFDR<br>AGMALGVKSGGYWPGNVQKDLTNHQSTVILFDPDTGQLKSLVGGNYLTAVRTAAASAVSIAHLARKDAK<br>VLGMIGAGHQSTFQLRAALEQRDFEKVVAWNPHPEHLPRLAAVCEELRVPFEAVTQQELGAQADVIITITS<br>AFEPLLLKEWIKPGTHIACMGTDTKGKQEVDPALLAAASVFTDEVAQSVLLGEAQHAVASGLIAESDITPIG<br>EVINGTHVGRRDDQEITLFDGTGVGLQDLAVASAAAELADQKGLSQTIVL |
| 251 | MKDAADAAAIAIVSEDVCKEVVSRADAFEAVEKVFAAMARGDAYNFPVIREAIGHADALYGFKSGFDRAG<br>LVLGLKSGGYWPGNAARGLTNHQSTVFLFDPDTGRLRALVGGNHLTALRTAAASAVSIAHLARRDAKVL<br>GMVGAGHQAQFQLRAAAEQRRFERVVAWNYHPDMLPKLGAVAAEIGLPFEAVERERLCAEADVIITIGSS<br>TEPQIMADVVKPGTHLACMGTDTRGKQEVDPALLARATVFTDEVAQSITIGEAQHAVAQGLIGEDAVTPL<br>GRVINGDHPGRTGDDEITLFDGTGVGLQDLAAAAVAMARAVESGKAQTLTL |
| 252 | MWIVPEREIADLLTRDASFDAVEKVFAAMAAGDAYNFPVIREAIGHEDALYGFKGGFDGVGGTLGLKAGG<br>YWPHNLEKRNLINHQSTVFLFDPDTGKVAAMVGGNYLTALRTAAASSVSIKHLARTDAKVMGMVGAGHQ<br>ATFQLRAALEQREFEKVIGWNYHPEMLPNIEKVANEAGVPFEAVELEGLGEADVVISITSTFAPTIMADHIS<br>AGTHIACMGTDTKGKQEVEAALLARATVFTDEVAQSISIGEAQHAIEAGLIQEADVHQIGAVINATHKGRTS<br>DDEITLFDGTGVGLQDLAVSAAIVRMAIEQGVAIEVDF |
| 253 | LIIVPERDIAGLIGPADCLAAVEGVFAAMARGTARNFPVVREALGHADALYGFKSGFDAESLALGLKSGGF<br>WPGNMARGLTNHQSTIFLFDADTGQCRAIVGGNRLTALRTAAASAISIKYLAREDARVLGIIGAGHQSTFQ<br>LEAALEQRAFEKIVGWNVEPDMLSKLEEVAARRGLPFERVDLDGLGAQADVIITITSSFAPILKAAQVRPGT<br>HIACMGTDVGKQEVEAELVSRASVFTDEVAQAVTLGESQHAVAAGLVDAGSIVEIGQVVTGAHPGRTSA<br>EEITLFDGTGVGPQDLAVASAVVDLAVRKGIATEVEF |

FIG. 12U

| | |
|---|---|
| 254 | METSSKEPSQPHQILIVNEDACREVIGRHEAFQAVEAVFASMARGGAYNFPVVREAIGHADALYGFKSGF DREALVLGVKSGGYWPGNAARGLTNHQSTVVLFDPDTGRLKALVGGNYLTAVRTAASSAVSIAHLARKD AKVLGMVGAGYQSTFQLKAALEQRAFEKVVAWNAHPEHLTRLAAICEEKGIPFEGVSRQELGAQSDVIITI TSAFEPLLDADWIKPGTHLACMGTDTKGKQEVDHKLLAQATVFTDEIAQSISIGEAQHAVAAQILSEDQITP IGEVINGTNPGRQSEADITLFDGTGVGLQDLAVASEAARLAETGGLAQRVTL |
| 255 | MKDMSDNGLLIVSEDLCQQLVGRKEAFDAVQDVFAAMARGDAYNFPVIREAIGYADALYGFKSGFDRAG QVLGVKSGGYWPGNTEKGLTNHQSTVFLFDPDTGRLSALVGGNYLTAVRTAASAAVSIAHLARRDSKVL GMVGAGHQSTFQLRAAAEHRDFEKVVAWNPHPEMLPRLEGVAHEVGLEFQAVTQEELGAQADVIITITS AFEPLLMKDWIKPGTHLACMGTDTKGKQEVDAMLVAHATVFTDEVAQSITIGETQHAVADGQLTKDQITPI GAVINGDHPGRGSDEEITLFDGTGVGLQDLAVASVAAKLADKAGLAGRATL |
| 256 | MWVVPEHEIAGLMTPEAAFDAVEAVFAAMARGDARNFPVVREALGHEDALYGFKGGFDGAGMTLGLKA GGYWPNNQKHGLINHQSTVFLFDPDTGRVSAAVGGNLLTALRTAAASAVSSKYLAPEGARVLGMIGAGH QSAFQMRAAVRFGQFEKVVGWNPHPAMLSRLADTAAELGLPFEAVDLPQLGADADVIITITSAFEPLLLD GHVTGPTHIAAMGTDTKGKQELDPALVARARLFTDEVAQSVSIGEFQHASAQKTVSADDITALGQVIIGNH PGRGDAQVTIFDGTGVGLQDLAVASAVVELAKQHGKAIQVAI |
| 257 | MYIVPERAIADLMTRKAAFDAVEQVFAAMAAGDAYNFPVVREAIGHEDALYGFKGGFDRAGLTLGLKAGG YWPNNLEKRGLINHQSTVFLFDPDTGKVRAMVGGNLLTALRTAAASSVSIKHLAREDAKVIGMIGAGHQA KFQLRAALEQREFDKVIGWNLHPEMLANLEEVATEAGLPFEAVELDGLKEADVIISITSSFDAILKADQVSP GTHIACMGTDTKGKQEVDPELLVRADVFTDEVAQSISIGEAQHAVAQGLIAEADVAQLGAVINGAHPGRT SAEQITLFDGTGVGLQDLAVASSVVELAVKQGIAIEVDF |
| 258 | MIIVPESAVRDLVSLEDCVNAVEKAFVSMAERSAQNFPVVREAIGYEDALFGFKSGFNREGLALGLKAGG FWPNNASKGLTNHQSTVFLFDPETGRCRAVVGGNLLTALRTAAASAVSIKYLARKDAKVLGMVGAGHQA SFQLRAAVQQRAFEKVVAWNFHPEMLPKLAAVADELAIPFEAVELDRLGDEADVIITITSSFQPILKAQQVR PGTHLACMGTDTKGKQEVDAALFASATLFTDEIAQAISIGESQHAIAQGLVAPVDIGEIGAVISGRIPGRSS ADQVTLFDGTGVGLQDLAVAQAAVELAIARGTAVEIEI |
| 259 | MLIVPEREIANLMTREAAFDAIEKVFAAMASGDAYNFPVVREAIGHEDALYGFKGGFDRAGLSLGLKAGG YWPNNLEKRNLINHQSTVFLFDPDTGKVKAMVGGNLLTALRTAAASSVSIKHLARKNATVIGMVGAGHQA TFQLRAALEQRKFEKVIGWNYHPEMLPNIEKVAHEAGVPFEAVDLPGMTEADVIISITSAFSPSLMADHVS PGTHIACMGTDTKGKQEVEAALLARASVFTDEVAQSVSIGEAQHAIAEGLIKDTDVAQLGAVINGTNPGRT SDHQITLFDGTGVGLQDLAVAAKVVDLAVEQGVAIDVDF |
| 260 | MLIVPEREIANLMTREAAFDAIEKVFAAMASGDAYNFPVVREAIGHEDALYGFKGGFDRAGLSLGLKAGG YWPNNLEKRNLINHQSTVFLFDPDTGKVKAMVGGNLLTALRTAAASSVSIKHLARKNATVIGMVGAGHQA TFQLRAALEQRKFEKVIGWNYHPEMLPNIEKVAHEAGVPFEAVDLPGMTEADVIISITSAFSPSLMADHVS PGTHIACMGTDTKGKQEVEAALLARASVFTDEVAQSVSIGEAQHAIAEGLIKDTDVAQLGAVINGTNPGRT SDHQITLFDGTGVGLQDLAVAAKVVDLAVEQGVAIDVDF |
| 261 | MHIVPERDIADLMTRAAAFDAVEKVFAAMAAEDAYNFPVIREALGHEEALYGFKGGFDRAGSTLGLKAGG YWPHNLEKRGLINHQSTVFLFDPDTGKVSAMVGGNLLTALRTAAASSVSIKHLAREDAKVIGMVGAGHQA TFQLRAALEQRSFEKVIGWNLHPEMLPNLEKVAAEAGLPFEAVDLPGLKEADVVITITSSFDPIVLSEHISD GTHVACMGTDTIGKQEVAADLLTRATVFTDEVAQSTTLGEAQHAVANGSLTADQITQLGAVINGTHGGRA SDREVTLFDGTGVGLQDLAVAARVVELAIEKGTAIEVDF |
| 262 | MNDMTQAQTDGLIIVSEEICQQVIGRQDAFDAVEAVFGAMAKGDAYNFPVIREAIGHADALYGFKSGFDR AGLALGLKSGGYWPGNADKGLTNHQSTVFLFDPDTGKLKALVGGNYLTALRTAAASSVSIAHLARKDAK VLGMVGAGHQSAFQLRAAAEQRDFEKVVAWNPHPEMLPKLGEVATQIGLEFEAVERDQLGAEADVIITIT SAFEPLMMASQIKPGTHIACMGTDTVGKQEVDPALLAAATVFTDEVAQSISLGEAQHAIAQGLIAEADITPI GNVINGTHPGRSSADEITLFDGTGVGLQDLAVASVAADLAAKAGTATRVAL |
| 263 | MIIVPENQIAGLITPADCLAAVEGVFASMAKRSAYNFPVIREAIGHADALYGFKSGFDRDSLALGLKSGGF WPNNVQKGLANHQSTVFLFDADTGRCRAVVGGNLLTALRTAAASAVSIKYLARRDAKVLGMIGAGHQST YQLRAAVEQRPFEKVLAWNLHPEMLSRLEGVARELELPFETVDLDRLGDEADVIISITSSFAPILKASQVRP GTHLACMGTDTKGKQEMDAELLAAATVFTDEVAQAVTIGECQHAIEKGLISRDDIVEIGAVITGRHTGRSS PEEITLFDGTGVGLQDLAVASAAVELALSKGTAIEVDF |
| 264 | MIIVPEKEIGALLGRNESYEAIEQVFAAMAAGDAYNFPVVREAIGHADALYGFKGGFDRAGMTLGLKAGG YWPNNLETHGLINHQSTVFLFDPDTGRVKAIVGGNLLTALRTAAASSVSINHLARKDAKVIGMVGAGHQA KFQLRAALEQREFEKVIGWNLHPDMLPNIEEVASEAGLPFEAVELPGMVEADVIITITSSFAPTLMSDHVSD GTHVACMGTDTVGKQEVGVDLINRATVFTDEVAQSITLGECQHAVSGSKTETDIRQIGEVINGTHPGRQ SDQEVTLFDGTGVGLQDLAVASAVVELAVEQGIAIEVDF |
| 265 | MIIVPENQIAGLITPADCLLAVEGVFASMAERSAYNFPVIREAIGHADALYGFKSGFDRDSLALGLKSGGFW PNNVEKGLANHQSTVFLFDADTGGCRAVVGGNLLTALRTAAASAVSIKYLARNDAKVLGMIGAGHQSTY QLRAAVEQRPFEKVLAWNPHEMLSRLERIARELELPFETVDLDRLGAESDVIISITSSFAPILKASQVRPG THLACMGTDTKGKQEVDPELVAAATVFTDEVGQAVTIGECQHAIDKGLISKDDIVEIGAVITGRHKGRSSS EEITLFDGTGVGLQDLAVASAAVELALSKGAAIEVDF |

FIG. 12V

| 266 | MIIQNDEMNTDKGITIISEAICEAVVGRPEAFTAVENVFAAMAKGDAYNFPVVREAIGHADALYGFKSGFDR AGMALGVKSGGYWPGNAKKNLTNHQSTIFLFDPDTGQLISLVGGNHLTAMRTAASSAVSIAHLARKDAKV LGMVGAGHQSTFQLRAALEQRKFEKVVAWNLHSADLQRLAKVCEELGLPFEALERKELGAQADVIITITS AFEPLMMKEWIKPGTHIACMGTDTKGKQEVDPELLVAATVFTDEIAQSVSIGEAQHAIASGTIKAEDIVPIG EVINGTHPGRLSDEEITLFDGTGVGLQDLAVAQAAAVLAEKQGLAVSINL |
| --- | --- |
| 267 | MWIVPEKEIAGLMTPEAAFDAVQAVFAAMASGKASNFPVVREAIGHEDALYGFKGGFDRSARNLGLKAG GYWPNNQRRELINHQSTVFLFDADTGRVQAAVGGNLLTALRTAAASAVSIKYLARPDAKVLGIVGAGHQS TYQLRAALDQRPFEKVLAWNRTPERLKRLEAAAQEKGLPFKSVTLEQLCRQADVVVTITSSFSPMIAEGLI RPGTHLACMGTDTRGKQEVAPEIVAASTVFTDEVAQSTTIGEAQHAFGMGLLDAAAIVPIGDVINKEHPGR RSAEEITLFDGTGVGIQDLAVASAAVDLAVARGRAVEVEM |
| 268 | MLVVAEKEIAGLMTPEAAFEAIEAVFASMARRKAYNFPVVREAIGHEDALYGFKGGFDAAALTLGLKAGG YWPNNQKHGLINHQSTVFLFDPDTGRVSAAVGGNLLTALRTAAASAVSIKHLAPKGAKVLGMIGAGHQSA FQMRAAANVHRFEKVIGWNPHPEMLSRLADTAAELGLPFEAVELDRLGAEADVIISITSSFSPLLLNEHVK GPTHIAAMGTDTKGKQELDPALVARARVFTDEVAQSVSIGECQHAIASGLIREDQIGELGAVVAGDDPGR GDAEVTIFDGTGVGLQDLAVAQKVLEIAKQEGLAQEVEI |
| 269 | MFIVPERDIADLMTREAAFDAVEKVFAAMASGDAYNFPVVREAIGHEDALYGFKGGFDRAGLTLGLKAGG YWPNNLEKRGIINHQSTVFLFDPDTGKAKAMVGGNLLTALRTAAASSVSIKHLARKDAKVIGMVGAGHQA KFQLRAALEQREFEKVIGWNFHPEMLPNLEEVASEAGLPFEAVALEGLTEADVIISITSSFDAILHADHVAP GTHIACMGTDTKGKQEVETALLGKATVFTDEVAQSISIGEAQHAIESQILRAEDITQVGAVINGTHPGRTSD EEITLFDGTGVGLQDLAVAAAVVDLAVAKGLAIEVDF |
| 270 | MIIVPEKEIAALLGRAEAFEAVESVFAAMSSGVAYNFPVIREAIGHADALYGFKSGFDRSSLALGLKSGGY WPGNADKGLTNHQSTVFLFDADTGKAKAVVGGNLLTALRTAAASAVSIKHLARKHAKVLGMIGAGHQSA FQMRAAVEQRSFEKVIGWNLHPEMLSRLEETAAELDLPFEAVDLDRLGAEADVIISITSSFDPILKVSQVTP GTHLACMGTDTKGKQEVEAELVAKATVFTDQVAQSSTIGECQYAVASGLISESDINEIGAVINGNHKGRTS VDEITLFDGTGVGLQDLAVASKVVDLAVEKGIAISVDF |
| 271 | MIIISEREIATLVSPADCFAAVEGVFASMAKGKAYNFPVVREAIGHADALYGFKSGFDRESLALGLKSGGF WPGNVEKGLTNHQSTIFLFDADTGCCRAIVGGNLLTALRTAASSALSIKYLARPEARVIGMIGAGHQSTFQ LSAALDQRRFEKVVGWNIEPSALGRLESVAVERGIPFEAVDLDRLGAEADVIITITSSFAPILKAAQVRPGT HLACMGTDTKGKQEVEAELLAKASVFTDEIAQATSIGEAQHAVAQGLLAATDIVAIGSVINGAHPGRRSPE DITLFDGTGVGLQDLAVASTAVDLAIARGVAREIDF |
| 272 | MIIVPEHAIDGLLTEAECFTAVEQVFASMARRRAGNFPVVREAIGHADALYGFKSGFDRDSLALGLKAGGF WPGNAAKGLTNHQSTVFLFDADTGRCRAVVGGNLLTALRTAAACAISVRHLARKDARVLGMIGAGHQSA FQLRAALAQRPFERVLAWNLHPGMFGRMEAVAREHGVAFEAVDLDRLGSEADVVVTITSSFAPILKAAQV RPGTHLACMGTDTRGKQEVEAELLAAATVCTDEVAQSVSIGEAQHAVARGLLAADSIVEIGAVINGDHPG RVSESEITLFDGTGVGLQDLAVAAVAVDRAVAKGLATEVDV |
| 273 | MIIVPEHAIDGLLTEAECFTAVEQVFASMARRRAGNFPVVREAIGHADALYGFKSGFDRDSLALGLKAGGF WPGNAAKGLTNHQSTVFLFDADTGRCKAVVGGNLLTALRTAAACAISVRHLARKDARVLGMIGAGHQSA FQLRAALAQRPFERVLAWNLHPGMFGRMEAVARERGVPFEVVDLDRLGAEADVVVTITSSFAPILKAAQV RPGTHVACMGTDTRGKQEVEAELLAAATVFTDEVAQSVSLGEAQHAVARGLLAADSIVEIGAVINGDHPG RVSDAEITVFDGTGVGLQDLAVAAVAVDRAVAKGLATEVDF |
| 274 | MLVVAEKEIGGLMTPEAAFEAIEAVFAAMDAGKAYNFPVVREAIGHEDALYGFKGGFDASALTLGLKAGG YWPNNQKHDLINHQSTIFLFDADTGRVAAAVGGNLLTALRTAAASAVSIKYLAPKGARVLGMIGAGHQSA FQMRAAARVHAFEKVIGWNPHPEMLTRLAETAAELGLPFEAVDLDRLGAEADVIVSITSSFSPLLMNEHV RGETHIAAMGTDTKGKQELDPALVARAKLYTDEVAQAVSIGECQHAVAQGLVEAAAITRLGAAVNGTDPG RDGAEITLFDGTGVGLQDLAVAAKVVQLAQAKGIAQTVEI |
| 275 | MLIVPEREIADLMTREAAFDAVEKVFAAMASGDAYNFPVIREAIGHEDALYGFKGGFDRAGLTLGLKAGG YWPNNLERHGLINHQSTVFLFDADTGMVKAMVGGNLLTALRTAAASSVSIKHLARRDAKVLGMVGAGHQ ATFQLRAALEQRAFEKVIGWNYHPEMLPRIEKVAAEAGVPFEAVELDGMREADVIISITSAYAASLMAKHV SPGCHVACMGTDTKGKQEVEAALLARATVFTDEIAQSVTIGEAQHAIAEGLIGESDIAQLGAVINGTLPGR TSQEQITLFDGTGVGLQDLAVAASVVALAVEKGAAIEVDF |
| 276 | MIIVPEREIAGLISASDCFTAVEQVFASMAKKSAYNFPVIREAIGHADALYGFKSGFDRESLALGLKSGGFW PNNMAKGLTNHQSTVFLFDADTGKCKAVVGGNLLTALRTAAASAVSIKYLARPDSKVLGMIGAGHQSTFQ LRAALEQRPFEKVIGWNLHREALSRLEAVAAEKGLPFEAVDLDRLGAEADVIITITSSFDPILEAAQVRPGA HLACMGTDTKGKQEVDAELVAASTVFTDEIAQSITIGEAQHAVAEGLIAAESIIEIGAVINGSHPGRTSEREI TLFDGTGVGLQDLAVASAAADLAVSKGVAIEVDF |
| 277 | MADGASAPANELVIVPEGMIPDILTREASFDAVEKVFAAMAAGEARNFPVVREAIGHEDALYGFKGGFDA VGGVLGLKAGGYWPHNLDRRGIINHQSTVFLFDPDTGRVKALVGGNYLTALRTAAASSVSIRHLARKDAK VLGMIGAGHQAKFQLRAAAETHAFEKVIGWNHPEMLPGLAEVAREVGLPFEAVELPGMSEADVIITITSS FAPTLLADHVSPGTHLACMGTDTKGKQEVEAALLGRARVFCDEVAQSVSIGEAQHAVAEGLLSEGDVTQ LGAVINGTHGGRGSDEEITLFDGTGVGLQDLAVADAIVKTAVAQGIATIVPL |

FIG. 12W

| 277 | MYVVPEKEIAGLMTPDAAFEAIEAVFASMARRKAYNFPVVREAIGYEDALYGFKGGFDAAGLSLGLKAGG YWPNNQKHNLINHQSTVFLFDPDTGRVSAAVGGNLLTALRTAAASAVSIKYLAPKGAKVLGMIGAGHQSA FQMRAAARVHNFEKVIGWNPHPEMLTRLADTAAELGLPFEAVELDRLGSEADVIISITSAFSPLLMDSHVK GPTHIAAMGTDTKGKQELDAALVARARVFTDEVAQSISIGEAQHAIAQGLIAEEAINELGAVVTGDHEGRG DAEVTIFDGTGVGLQDLAVAHKSVEIAKQKGVALTVEI |
| 279 | MSTSVNGAGVAIVSEAVCEQIVGRPEAFKAVESVFGAMARGDAYNFPVVREAIGHADALYGFKSGFDRA GMVLGVKSGGYWPGNVQKDLTNHQSTVILFDPDTGRLKALVGGNYLTAVRTAAASAVSIAYLARKDAKV LGMVGAGHQSTFQLRAALEQRAFEKVVAWNPHPEYLSRLAAVCDELRVPFEAVDQQQLGAQADVIITITS AFEPLMMKEWIKPGTHIACMGTDTKGKQEVDPELLAAATLFTDEVAQSISIGEAQHAVASGLISESDITPIG EVINGTHPGRRDDQEITLFDGTGVGLQDLAVASAAANLALEQGLALRIAL |
| 280 | MLIVPEREIADLMTREAAFAAVEKVFAAMAAGDAYNFPVVREAIGHEDALYGFKGGFDRSGLTLGLKAGG YWPNNLEKRGIINHQSTVFLFDPDTGKARAMVGGNLLTALRTAAASSVSIRHLAREDARVIGMVGAGHQA TFQLRAALEQRDFDKVIGWNLHPEMLPNLEKVAAEAGVPFEAVELTGMREADVIISITSSFDAILMAEHVS PGCHIACMGTDTKGKQEVSPALLAKATVFTDEVAQSVSIGEAQHAVAQGLIDESAITQLGAVINGAHPGR RSAEEITLFDGTGVGLQDLAVAAAVVDLAVEKGIAIEVDF |
| 281 | MLIVPEREIADLMTRDAAFDAVEKVFAAMASGDAYNFPVVREAIGHEDALYGFKGGFDQAGLTLGLKAGG YWPNNLEKRGLINHQSTVFLFDPDTGKAKAMVGGNLLTALRTAAASSVSIKHLARSDSKVIGMVGAGHQA TFQLRAALEQRNFEKVIGWNYHPEMLPNIEKVANEAGLPFEAVDLPGLTEADVIISITSAFAPSVMAEHISE GTHIACMGTDTKGKQEVEAALLVKADVFTDEVAQSISIGEAQHAVAQGLIKETDVAQLGAVINGTIAGRTS DDQITLFDGTGVGLQDLAVAASVVDLAVEKGIAIEVDF |
| 282 | MIIVPEAAIADLVDRAAAFDAVEATFAAMASGDARNFPVVREALPGPEEALYGFKGGVDASAEALGLKAG GYWPHNLERRGLINHQSTVFLFDPETGRPTAMVGGNLLTALRTAAASSVSIRHLAREDARVIGMVGAGH QAGFQLRAALEQRPFEKVIGWNLHPEMLPNLEKVAAEAGLPFEAVELEGLRAADVIVTITSSFAPTLMAGH VGPGAHVACMGTDTVGKQEVDPELLKLATVFADEVAQSVTLGEAQHAVGAGTIAEGDLTPIGDVIRGVHP GRTSQEEITLFDGTGVGLQDLAVAAAAVRLAQEKGVAVEVEI |
| 283 | MLIVPEREVAGLMTREAAFTAVEQVFAAMANGNAYNFPVVREAIGHEDALYGFKGGFDRTGLALGLKAG GYWPNNLEKRGMINHQSTVFLFDPDTGKARAMVGGNLLTALRTAAASSVSIRHLAREECKVIGMVGAGH QATFQLRAALEQRAFEKVIGWNMHPEMLPNIEKVAAEAGLPFEAVELDGLRAADVIISITSSFDAILTADHV APGTHIACMGTDTKGKQEVSPELLSKATVFTDEVAQSVSIGEAQHAVALGLIREADISQLGAVIDGTHPGR QSDEEITLFDGTGVGLQDLAVAAAVVDLAVEKGIAIEVDF |
| 284 | MIIVPEKEIGALLGRKESYEAIEQVFAAMASGNAYNFPVVREAIGHADALYGFKGGFDQAGMTLGLKAGG YWPNNLETHGLINHQSTVFLFDPDTGRVKAVVGGNLLTALRTAAASSVSINYLARKDAKVIGMVGAGHQA KFQLRAALEQRNFEKVIGWNLHPEMLPNLEEVAAEAGLPFEAVELSGMTEADVIITITSSFAPTLMSDHVS DGTHIACMGTDTIGKQEVGVDLIARASVFADEIAQSITLGECQHAIANGSKAEADIRQVGEVINSTHQGRTS DDEVTLFDGTGVGLQDLAVASAVVDLAVEQGIAIKVDF |
| 285 | MNAPDKTATAANMVTIVPESEIGGLMDAASAFDAVEATFAAMARGDAYNFPVIREAIGHADALYGFKSGF DKAALALGLKSGGYWPGNEARGLTNHQSTVILFDADTGRVKALVGGNLLTALRTAAASAVSIAHLSRKDS KVLGMVGAGHQSAFQMRAACAQRDFDKVVGWNYHPEMLSRLEDTAKELGLPFEAVEREDLCAQADVII TITSSHDAQLMADWVKPGTHVACMGTDTKGKQEVDPALLARASVFTDEVAQSVTLGEAQHAVAQGLIKE ADITPIGAVIEGTAKGRTSDDQVTLFDGTGVGLQDLAVAAKVVDLALKAGKAQQVPF |
| 286 | MYIVPERAIADLMTRDAAFDAVEKIFAAMAAGDAYNFPVVREAIGHEDALYGFKGGFDSAGLSLGLKAGG YWPNNLEKRGLINHQSTVFLFDPDTGKVRAMVGGNLLTALRTAAASSVSIKHLAREDAKVIGMGAGHQA KFQLRAALEQRDFDKVIGWNPHEMLPNLKEVATEAGLPFEAVELDGLKEADVIISITSSFDAILKADQVSP GTHIACMGTDTKGKQEVDPQLLVRATVFTDEVAQSISIGEAQHAVAQGLITEADVAQLGAVINGAHPGRS SAEQITLFDGTGVGLQDLAVAASVVELAVKKGVAIEVDF |
| 287 | MYIVPEKAVADLVTREASFDAVEKVFAAMASGDAYNFPVVREAIGHEDALYGFKGGFDRAGLTLGLKAG GYWPNNLEKRGLINHQSTVFLFDPDTGKVKAMVGGNLLTALRTAAASSVSIKHLARQDAKVIGMIGAGHQ AKFQLRAALEQRNFEKVIGWNFHPDMLPNIEKVAAEAGVPFEAVDLPGMRDADVIISITSAFAPSLMADHV SPGTHVACMGTDTKGKQEVEAALLVKSTVFTDEVAQSITIGEAQHAVAQGLIQESDVAQLGAVINGTNPG RTSDDQITLFDGTGVGLQDLAVAASVVEVAVEKGIAIEVDF |
| 288 | MYIVPEKAVADLVTREASFDAVEKVFAAMASGDAYNFPVVREAIGHEDALYGFKGGFDRAGLTLGLKAG GYWPNNLEKRGLINHQSTVFLFDPDTGKVKAMVGGNLLTALRTAAASSVSIKHLARQDAKVIGMIGAGHQ AKFQLRAALEQRNFEKVIGWNFHPDMLPNIEKVAAEAGVPFEAVDLPGMRDADVIISITSAFAPSLMADHV SPGTHVACMGTDTKGKQEVEAALLVKSTVFTDEVAQSITIGEAQHAVAQGLIQESDVAQLGAVINGTNPG RTSDDQITLFDGTGVGLQDLAVAASVVEVAVEKGIAIEVDF |
| 289 | MWVVPEKEIAGLMTPEAAFDAIESVFASMARRKAYNFPVVREAIGYEDALYGFKGGFDAAALTLGLKAGG YWPNNQKHGIINHQSTVFLFDPDTGRVAAAVGGNLLTALRTAAASAVSIKHLAPKGASVLGMIGAGHQSV FQMKAAARVNKFERVLGWNPHPEMLGRLADTAAELGLPFEAVELDRLGAEADVIIAITSSFAPLLMDGHV KGPTHIAAMGTDTKGKQELDPALVARARLFTDEIAQSVSIGEYQHVIAGNLVQQDAIGELGAVVTGDNPG REGDEVTIFDGTGVGLQDLAVAAAVVELAKQKGVAQRVEI |

FIG. 12X

| | |
|---|---|
| 290 | MLIVPEREIADLMTREAAFDAVEQVFASMASGDAYNFPVVREAIGHEDALYGFKGGFDRAGLTLGLKAGG YWPNNLEKHGLINHQSTVFLFDPDTGRPTAMVGGNLLTALRTAAASSVSIKHLARTDAKILGMIGAGHQA AFQLRAALEQRNFEKVIGWNYHPEMLPNIEKVAAEAGIPFEAVPLDGMRQADVIISITSAFAPSLMADHVS AGTHVACMGTDTKGKQEVESALLAGAGVFTDEVAQSVTIGEAQHAVAEGLIKESDVAQLGAVINGTHPG RSSDDQITLFDGTGVGLQDLAVAASVVELAVRKGIAIEVDF |
| 291 | MKSDGLLIVGEDLCEKLVGRQQAFDAVQAVFGAMAKGGAWNFPVIREALGHADVLYGFKSGFDRDGQV LGLKSGGYWPGNAAKGLTNHQSTVFLFDPDTGRLSALVGGNYLTAVRTAASSAVSIAHLARQDARVLGM VGAGHQSTFQLRAAAEQRDFEKVIAWNPHPDMLPRLAAVATEVGLEFEAVSQQELGAQADVIITITSAFE PLLMKDWIKPGTHLACMGTDTKGKQEVDADLVAAATVFTDEVAQSVTIGEAQHAINLGALTEDAIAPIGAVI NGDHPGRTSDDQITLFDGTGVGLQDLAVASVAARLAEEADLAQRATL |
| 292 | MLIVPEREIADLMTREAAFDAVEKVFAAMAARDAYNFPVVREAIGHEDALYGFKGGFDQAGLTLGLKAGG YWPNNLEKRDLINHQSTVFLFDPDTGKAKAMVGGNLLTALRTAAASSVSIKHLARDDAKVIGMIGAGHQA TFQLRAALEQRQFEKVIGWNYHPEMLPNIEKVATEAGLPFEAVKLDGMKEADVIISITSAFAPSLMADHVA PGTHIACMGTDTKGKQEVESALLAKASVFTDEVAQSISIGEAQHAVAEGLIKESDVGEIGAVINGTNPGRT SADQITLFDGTGVGLQDLAVAAAVVDLAVEKGIAIEVDF |
| 293 | MLIVPEREIANLMTREAAFDAIEKVFAAMASGDAYNFPVVREAIGHEDALYGFKGGFDRAGLSLGLKAGG YWPNNLEKRNLINHQSTVFLFDPDTGKVKAMVGGNLLTALRTAAASSVSIKHLARKNATVIGMVGAGHQA TFQLRAALEQRKFEKVIGWNYHPEMLPNIEKVAHEAGVPFEAVDLPGMTEADVIISITSAFSPSLMADHVS PGTHIACMGTDTKGKQEVEAALLARASVFTDEVAQSVSIGEAQHAIAEGLIKDTVAQLGAVINGTNPGRT SDHQITLFDGTGVGLQDLAVAAKVVDLAVEQGVAIDVDF |
| 294 | MSEANSVNSDEGLLIVSEDACKSVIDRPSAFIAVENVFASMSRGDAYNFPVIREAIGYADALYGFKSGFDR AGKSLGLKSGGYWPGNAAKGLTNHQSTIFLFNPDNGKLRALVGGNYLTAVRTAAASAVSIAHLARKDSKV LGMVGAGHQSTFQLRAALEQRNFEKVVAWNKNKDRLKNLQAVAEEELGVPFEAVEREQLCSEADVIITITS AFEPLLMKEWIKPGTHIACMGTDTVGKQEVDVNLIAAATVFTDEITQSISLGETQHAIKSGAIKESDITTLGD VINGEHPGRSSDDEITLFDGTGVGLQDLAVASAATKLALEKGEAQHISL |
| 295 | MYIVPEKAVADLVTREASFDAVEKVFAAMASGDAYNFPVVREAIGHEDALYGFKGGFDRAGLTLGLKAG GYWPNNLEKRGLINHQSTVFLFDPDTGKVKAMVGGNLLTALRTAAASSVSIKHLARQDAKVIGMIGAGHQ ATFQLRAALEQRPFEKVIGWNYHPEMLPNIEKVAAEAGVPFEAVDLPGMADADVIISITSAFAPSLMADHV SPGTHIACMGTDTKGKQEVEAELLVKATVFTDEVAQSISIGEAQHAVAQGLIQESDVAQIGAVINGTNPGR TSDDQITLFDGTGVGLQDLAVAASVVEVAVEKGIAIEVDF |
| 296 | MSDSQINKGVSVISEEVCQQVMGRANAFTAVENVFSAMAKKTAYNFPVIREAIGHADALYGFKSGFDRD GMVLGLKSGGYWPSNMAKGLTNHQSTVILFDPDTGKLKSLVGGNYLTAVRTAASSAISIAYLARKDAKVL GMIGAGHQSTFQLRAAVEQRNFEKVVCWNLHPEHISNLAAVAEELGLPFESVTREELCAQADVIITITSAF EALIEKDWIKPGTHIACMGTDTKGKQEVDAKLLTVAKVFTDELAQSITIGEAQHAIARKLIQQSDIVPIGEVIN GTKPGRTSAEDITLFDGTGVGLQDLAVASLAAELAEAKGLATYFKL |
| 297 | MIIVPEREIANLMTREAAFVAVEQVFAAMAAQDAYNFPVIREAIGHEDALYGFKGGFDRAGKTLGLKAGGY WPNNLDKHQIINHQSTVFLFDPDTGKAKAMVGGNLLTALRTAAASSVSIKHLARKDARVIGMIGAGHQATF QLRAALEQRQFEKVIGWNFHPEMLPNLEKVADEAGLPFQAVDLNGLRDADVLISITSSFEAILQADQVSPG THIACMGTDTKGKQEVDPALLTRATVFSDEVAQSISIGEAQHAIAMELITEHDITQIGAVINGTHPGRTSDD QITLFDGTGVGLQDLAVAASVVDLAVANGVAIEVDF |
| 298 | MIIVPEHAIDGLLTEAECFGAVEQVFASMARRRAGNFPVVREAIGHADALYGFKSGFDRDSLALGLKAGG FWPGNAAKGLTNHQSTVFLFDADTGRCKAVVGGNLLTALRTAAACAISVRHLAREDARVLGMIGAGHQS AFQLRAALAQRPFDRVLAWNLHPGMFGRMEAVAREHGVPFEAVELDRLGAEADVIVTITSSFAAILKAAQ VRPGTHVACMGTDTRGKQEVEAELLAAATVFTDEVAQSVSIGEAQHAVARGLLAADSIVEIGAVINGDHP GRISESEITVFDGTGVGLQDLAVAAVAVDRAVAKGLATEVDF |
| 299 | MIIVPEHAIDGLLTEAECFTAVEQVFASMARRRAGNFPVVREAIGHADALYGFKSGFDRDSLALGLKAGGF WPGNAAKGLTNHQSTVFLFDADTGRCRAVVGGNLLTALRTAAACAISVRHLARKDARVLGMIGAGHQSA FQLRAALAQRPFERVLAWNLHPGMFGRMEAVAREHGVAFEAVDLDRLGSEADVVVTITSSFAPILKAAQV RPGTHLACMGTDTRGKQEVEAELLAAATVCTDEVAQSVSIGEAQHAVARGLLAADSIVEIGAVINGDHPG RVSESEITLFDGTGVGLQDLAVAAVAVDRAVAKGLATEVDV |
| 300 | MIIVPEKDIADLMTREAAFAAVEQVFAAMASGDAYNFPVVREAIGHADALYGFKGGFDRLGGVLGLKAGG YWPHNLETHGIINHQSTVFLFDPDTGRVAAMVGGNLLTALRTAAASSVSIRHLAREDAEVLGMIGAGHQA AFQLRAALEHRSFGKVVGWNYHPEMLPNLEKVAAEAGVAFEAVDLPGMREADVIVTITSSFDATLMAEHV APGTHVACMGTDTKGKQEVDPALLAAATVFADEIAQSVSIGEAQHAVSAGLISESDIAELGAVINGSHPGR RSDEEITLFDGTGVGLQDLAVAAAVVALARANDTAIEVEV |
| 301 | MAAGIGCAAVAYFKELLMIIVPEHEISGLMTRQDSFDAVEKVFASMASGAAYNFPVIREAIGHADALYGFK SGFDRAGLNLGLKSGGYWPGNADKGLTNHQSTVFLFDADTGKCRAIVGGNLLTALRTAAASAVSIKYLAP KSAKVLGMIGAGHQSSFQLRAALDQRAFEKVIGWNLHPEHLSRLEDVATEAGLPFEAVELDQLGQEADTI ITITSSFAPILKNAHVTGGTHIACMGTDTVGKQEVDAELVARAQVFTDEVAQSISLGECQHAMSAGLIRQE QIAQIGDVINGTHTGRTSENDITLFDGTGVGLQDLAVASAVVELAVARGVAIEVDF |

FIG. 12Y

| | |
|---|---|
| 302 | MDGSPMKSHEIIIVPEAEIAGLMTPEAAFDAVEAIFGAMARKDAYNFPVIREAIGHADALYGFKSGFDRAG GALGLKSGGYWPGNEAKGLTNHQSTVILFDRDTGRPKAMVGGNLLTALRTAAASAVSIKHLARADSKVL GMIGAGHQSAFQMRAALAQRPFEKVIGWNYHPEMLSRLEAVATEAGLPFEAVDLDRLGAEADVIISITSSF DAILHDAQVTAGTHVACMGTDTKGKQEVEAALVARATVFTDEIAQSTTIGEAQHAIASGLITEAAITEIGAVI NGTHPGRTSAEEVTLFDGTGVGLQDLAVAEAVVDLALKTGVATRVPF |
| 303 | MIIVPEHAIDGLLTEAECFTAVEQVFASMARRRAGNFPVVREAIGHADALYGFKSGFDRDSLALGLKAGGF WPGNAAKGLTNHQSTVFLFDADTGRCRAVVGGNLLTALRTAAACAISVRHLARKDARVLGMIGAGHQSA FQLRAALAQRPFERVLAWNLHPGMFGRMEAVARERGVPFEAVDLDRLGAEADVVVTITSSFAPILKAAQV RPGTHVACMGTDTRGKQEVEAALLAAATVFTDEVAQSVSIGEAQHAVARGLLAADSIVEIGAVINGDHPG RVSESEITLFDGTGVGLQDLAVAAVAVDRAVAKGLATEVDV |
| 304 | MLVVAEKEIAGLMTPEAAFEAIEAIFASMARRKAYNFPVVREAIGHEDALYGFKGGFDASALVLGLKAGGY WPNNQKHNLINHQSTVFLFDPDTGRATAAVGGNLLTALRTAAASAVSIKYLAPKGAKVLGMIGAGHQSAF QMRAVANVHPFEKVIGWNPHPEMLSRLADTAAELGLPFEAVELDRLGTEADVIISITSSFSPLLMDQHVKG PTHIAAMGTDTKGKQELDPALVARARIFTDEVAQSVSIGECQHAIASGLIREDQIGELGAVVAGDHPGRGD AEVTLFDGTGVGLQDLAVAQKVLEIAKEKGLAQEVEI |
| 305 | MIIVPETEIAGLVTPADCFRAVEGVFASMADKSAHNFPVVREAIGHADALYGFKSGFDRKGLALGLKAGGF WPNNVHKGLTNHQSTVFLFDPDTGKCRAVVGGNLLTALRTAAASAISIKYLARKDAKVLGMIGAGHQATF QLRAALAQRPFERIVGWNLHPDMLSRLEEVAKEEGLPFEAVDLDRLGAEADVIISITSSFAPMLKASQVRA GTHLACMGTDTKGKQEVEAEILAAAAVFTDEVAQAVTIGESQHAIERGLIREEAIVEIGAVINGTHPGRTSA DQITLFDGTGVGLQDLAVASAAVELALAKGVAIEVDF |
| 306 | MIIVPEHAIAGLVSASDCLEAVEQVFAAMARRSARNFPVIREALGHADALYGFKSGFDRESLALGLKSGGF WPGNISRGLTNHQSTVFLFDADTGACRAVVGGNLLTALRTAAASAISIKHLARPDARVLGMIGAGHQSSF QLRAALAQRHFEKVVGWNLHQPDLARLNAVATELGVPFEAVDLDRLGAEADVIITITSSFDPILMAAQVRP GTHLACMGTDTAGKQEVEPALVAAATVFTDEITQSITLGEAQHAAAQGLLAAAQITELGAVINGTHPGRTS AQEITLFDGTGVGLQDLAVASVAVDRALDKGVAITVDFQSPIGPAGATSP |
| 307 | MIIVPEKEIAGLMTREAAFDAVEAVFAAMSKGSAYNFPVIREAIGHADALYGFKSGFDRESLALGLKSGGF WPGNDAKGLTNHQSTIFLFDADTGQCRALVGGNLLTALRTAAASSVSIKHLARADAKVLGMIGAGHQSTF QMRAALEQRDFEKVIGWNYHPDMLSRLSDLADELGIPFEAVDLERMGQEADVIISITSAFAPSLMDAHISH GTHIACMGTDTKGKQEVETALLGRAKVFTDEIAQSVSIGEAQHAIAAGLLTADQITEIGSVINGDSPGRTSA DDITLFDGTGVGLQDLAVASTVVDLAVAQGVAIEIEF |
| 308 | MIIVSEREIATLVSPADCFAAVEGVFASMAKGKAYNFPVVREAIGHADALYGFKSGFDRESLALGLKSGGF WPGNVEKGLTNHQSTIFLFDADTGCCRAIVGGNLLTALRTAASSALSIKYLARPEARVIGMIGAGHQSTFQ LSAALDQRRFEKVVGWNIEPSALGRLESVAVERGIPFEAVDLDRLGAEADVIITITSSFAPILKAAQVRPGT HLACMGTDTKGKQEVEAELLAKASVFTDEIAQATSIGEAQHAVAQGLLAATDIVAIGSVINGAHPGRRSPE DITLFDGTGVGLQDLAVASTAVDLAIARGVAREIDF |
| 309 | MIIVPEHAIDGLLTEAECFTAVEQVFASMARRRAGNFPVVREAIGHADALYGFKSGFDRDSLALGLKAGGF WPGNAAKGLTNHQSTVFLFDADTGRCRAVVGGNLLTALRTAAACAISVRHLARKDARVLGMIGAGHQSA FQLRAALAQRPFERVLAWNLHPGMFGRMEAVAREHGVAFEAVDLDRLGSEADVVVTITSSFAPILKAAQV RPGTHLACMGTDTRGKQEVEAELLAAATVCTDEVAQSVSIGEAQHAVARGLLAADSIVEIGAVINGDHPG RVSESEITLFDGTGVGLQDLAVAAVAVDRAVAKGLATEVDV |
| 310 | MRDEMNTQTDGLLIVDEDACEQLVGRQQAFDAVQDVFAAMARGDARNFPVVREALGHADAIYGFKSGF DRSGQVLGVKSGGYWPGNSQKGLTNHQSTVVLFDPDTGRITALVGGNYMTAVRTAASSAISIAHLARPD AQILGMVGAGHQSTFQLRAAAEQREFEKVVAWNPHPEMLPRLAEVAEDLGLEFEATTPEGLGAQADVIIT ITSAFEPLLKKDWVKPGTHLACMGTDTKGKMEVDPALVAAATLFTDEVAQSISIGEAQHAALKGEISQDAI TPIGAVINGDHIGRSNDAEITLFDGTGVGLQDLAVASVAAQLAKNTGLANKVTL |
| 311 | MIIVPEREIANLMTREAAFVAVEQVFAAMAAQDAYNFPVIREAIGHEDALYGFKGGFDRAGKTLGLKAGGY WPNNLDKHQIINHQSTVFLFDPDTGKAKAMVGGNLLTALRTAAASSVSIKHLARKDARVIGMIGAGHQATF QLRAALEQRQFEKVIGWNFHPEMLPNLEKVADEAGLPFQAVDLNGLRDADVLISITSSFEAILQADQVSPG THIACMGTDTKGKQEVDPALLTRATVFSDEVAQSISIGEAQHAIAMELITEHDITQIGAVINGTHPGRTSDD QITLFDGTGVGLQDLAVAASVVDLAVANGVAIEVDF |
| 312 | MSGRKRKTKTMIIVPEKEIAGLLTRADAFEAVEKVFASMSKGSAYNFPVIREAIGYEDALYGFKGGFDKAG MALGLKAGGYWPNNLEKHGEINHQSTVFLFDPDTGKVKAMVGGNLLTALRTAAASSVSIKHLARKDAKV MGMVGAGHQATFQLRAALEQRDFEKVIGWNYHPEMLPNIERVANEAGLPFEAVPLEGLAEADVVISITST FAPTIMADHIAPGTHIACMGTDTKGKQEVEASLLARATVFTDEVAQSISIGEAQHAIASGLIEQSDVHELGA VINGTHPGRTSADEITLFDGTGVGLQDLAVASSIVDLAVEKGVATIVDF |
| 313 | MIIVPENKIGDLMTRADSFAAVEKVFASMAKGSAYNFPVIREAIGHADALYGFKSGFDRSELVLGLKSGGF WPGNMEKGLTNHQSTVFLFDADTGKCKAVVGGNLLTALRTAAASAVSIKYLAPKGAKVLGMIGAGHQSA FQMRAAAEQRDFEKVIGWNVDPAMLSRLEETAAEIGLPFEAVDLDRLGAEADTIITITSSFDAILMDAQVTG GTHIACMGTDTKGKQEVDAALVGRATVFTDEVAQSISIGEAQHAVANGVLKEADIAQIGAVINGDHPGRTS DDELTLFDGTGVGLQDLAVADAVVKRAVEAGVAVEVDF |

FIG. 12Z

| | |
|---|---|
| 313 | MYIVPEKAIADLVTREASFDAVEKVFAAMAAGDAYNFPVVREAIGHEDALYGFKGGFDRAGLTLGLKAGG YWPNNLEKRGLINHQSTVFLFDPDTGKVKAMVGGNLLTALRTAAASSVSIKHLARQDAKVIGMIGAGHQA TFQLRAALEQRQFEKVIGWNYHPEMLPNIEKVAAEAGLPFEAVDLPGMTEADVIISITSAFAPSLMADHVS PGTHIACMGTDTKGKQEVEAELLVKASVFTDEVAQSISIGEAQHAVAQGLIQESDVAQIGAVINGTNPGRT SDDQITLFDGTGVGLQDLAVAASVVEVAVEKGIAIEVDF |
| 315 | MLIVPEREIADLMTREAAFDAVEKVFAAMASGDAYNFPVVREAIGHEDALYGFKGGFDRAGLTLGLKAGG YWPNNLDKRGIINHQSTVFLFDPDTGMVKAMVGGNLLTALRTAAASSVSIRHLARKDARVIGMIGAGHQA RFQLRAALEQRDFEKVIGWNFHPEMLPNLQEVAEAAGLPFEAVELDGMREADVIVSITSSFDAILGADQV SPGTHVACMGTDTKGKKEVDPQLLVRADVFTDEVAQSVSIGEAQHAVGRGLISEADVAQLGAVINGSHA GRSSDDQITLFDGTGVGLQDLAVAAAVVDLAVERGIAIEVDF |
| 316 | MYIVPERAIADLMTRDAAFDAVEKVFAAMAAGDAYNFPVVREAIGHEDALYGFKGGFDRAGLSLGLKAGG YWPNNLEKRGLINHQSTVFLFDPDTGKVRAMVGGNLLTALRTAAASSVSIKHLAREDAKVIGMIGAGHQA KFQLRAALEQRDFDKVIGWNLHPEMLLNLEEVATEAGLPFEAVELDGMRAADVIISITSSFDAILKADQVSP GTHIACMGTDTKGKQEVDPQLLVRATVFTDEVAQSTSIGEAQHAVAQGLIGEADVAQLGAVINGAHPGRT SAEQITLFDGTGVGLQDLAVAASVVELAVKKGIAIEVDF |
| 317 | MWIVPEREIAGLMTREAAFGAVEKVFSSMASGDAHNFPVIREAIGHEEALYGFKGGFDRAGAALGLKAG GYWPHNLEKRGLINHQSTVFLFDPDTGKASAMVGGNLLTALRTAAASSVSIKHLARSDAKVIGMVGAGH QATFQLRAALEQRNFDKVIGWNLHPEMLPNLEKVATQAGLPFEAVELDGLHEADVIITITSSFEASLMSHH VSDGTHIACMGTDTVGKQEVEPALIERASVFTDEVAQAISLGESQHAVCAGTKAESDINEIGAVINGTHRG RKSDDEVTLFDGTGVGLQDLAVAASVVDLAIAKGVAIEVDF |
| 318 | MTTQDGLLIVGEDLCEQLVGRQQAFDAVQSVFGAMANGGARNFPVVREALGYADALYGFKSGFDRDGQ VLGVKSGGYWPGNAEQGLTNHQSTVFLFDPDTGRLSALVGGNYLTAVRTAASSAVSIAQLARKDAKVLG MVGAGHQSAFQLRAAAEQRDFEKVVAWNPHPDMLPRLAAVAEEIGLEFEAVSQQELGAQSDVIITITSAF EPLLMKDWIKPGTHLACMGTDTKGKMEVDPALVASATVFTDEVAQSATIGEAQHAMGSGTLTETQITPIG AVINGDHPGRSSADEITLFDGTGVGLQDLAVASVAARLADEAGLAQRATL |
| 319 | MDGSPMKSHEIIIVPEAEIAGLMTPEAAFDAVEAIFGAMARKDAYNFPVIREAIGHADALYGFKSGFDRAG GALGLKSGGYWPGNEAKGLTNHQSTVILFDRDTGRPKAMVGGNLLTALRTAAASAVSIKHLARADSKVL GMIGAGHQSAFQMRAALAQRPFEKVIGWNYHPEMLSRLEAVATEAGLPFEAVDLDRLGAEADVIISITSSF DAILHDAQVTAGTHVACMGTDTKGKQEVEAALVARATVFTDEIAQSTTIGEAQHAIASGLITEAAITEIGAVI NGTHPGRTSAEEVTLFDGTGVGLQDLAVAEAVVDLALKTGVATRVPF |
| 320 | MLIVPEREIADLMTRDAAFDAVEKVFAAMAAGDAYNFPVVREAIGHEDALYGFKGGFDQAGLTLGLKAGG YWPHNLEKRGIINHQSTVFLFDPDTGKAKAMVGGNLLTALRTAAASSVSIKHLARDDASVIGMIGAGHQAT FQLRAALEQRQFEKVIGWNYHPDMLPNIEKVATEAGLPFEAVELEGMVDADVIISITSAFAPSLMADHVSP GTHIACMGTDTKGKQEVEAALLARAAVFTDEVAQSISIGEAQHAIGAGLIAETDINQLGAVINGTHAGRTSD DQITLFDGTGVGLQDLAVAAAVVDLAVQKGIAIEVDF |
| 321 | MLIVPEREIANLITAADCFTAVERVFASMANKAAYNFPVIREAIGHADALYGFKSGFDRESLALGLKAGGF WPNNVSKGLTNHQSTIFLFDADTGKCRAAVGGNLITALRTAAASAVSIKYLARQEAKVLGMIGAGHQSAF QLRAALQQRQFEKVVAWNFHPEMLSRLEQVANDEGLPFEVLDLERLGAESDVIISITSSFAPLLKASQVRP GTHVACMGTDTKGKQEVEPELVAMATVFTDEIAQAVTIGECQHAVERGITNKEAIIEIGAVISGKHPGRSS ADEITLFDGTGIALQDLAVASVAVELALVKGVAIEIDF |
| 322 | MLIVPEREIADLMTRAAAFDAIEKVFAAMASGDAYNFPVVREAIGHEDALYGFKGGFDRAGLTLGLKAGG YWPNNLEKRGLINHQSTVFLFDPDSGKVKAMVGGNLLTALRTAAASSVSIKHLARKDASVLGMVGAGHQ ATFQLRAALEQRNFEKVIGWNYHPEMLPNIEKVAQEAGVPFEAVDLPAMTEADVIISITSAFAPSLMADHV SPGTHVACMGTDTKGKQEVEAALLGRAAVFTDEVAQSVSIGEAQHAIAEGIITETDVAQLGAVINGDHPG RISKDQITLFDGTGVGLQDLAVAAKVVDLAVEKGIAVEVDF |
| 323 | MLIVPEREIADLMTRAAAFDAIEKVFAAMASGDAYNFPVVREAIGHEDALYGFKGGFDRAGLTLGLKAGG YWPNNLEKRGLINHQSTVFLFDPDSGKVKAMVGGNLLTALRTAAASSVSIKHLARKDASVLGMVGAGHQ ATFQLRAALEQRNFEKVIGWNYHPEMLPNIEKVAQEAGVPFEAVDLPAMTEADVIISITSAFAPSLMADHV SPGTHVACMGTDTKGKQEVEAALLGRAAVFTDEVAQSVSIGEAQHAIAEGIITETDVAQLGAVINGDHPG RISKDQITLFDGTGVGLQDLAVAAKVVDLAVEKGIAVEVDF |
| 324 | MIIVPEKEIAGLIGRQESFDAVESVFAAMAGGAAYNFPVIREAIGHADALYGFKSGFDRSSLALGLKSGGY WPGNMAKGLTNHQSTVFLFDADTGKAKAVVGGNLLTALRTAAASAVSIKHLARKDAKVLGMIGAGHQSA FQMRAAVEQRDFEKVLGWNLHPEMLVRLEETANELGLPYESVDLARLGAEADVIISITSSFDPILMEEHVS PGTHIACMGTDTKGKQEVDVALVAKAKLFTDEIAQSATIGECQHAVASGIVSEDNIIEIGAVINGNHPGRTS QSDITLFDGTGVGLQDLAVASAAVDLAIQKGVAIEVDF |
| 325 | MLIVPERQIPDLLTRSASFTAVEKVFAAMAAGQAYNFPVIREAIGHEDALYGFKGGFDRDGHTLGLKAGG YWPHNLEKRGLINHQSTVFLFDPDSGMISAMVGGNYMTALRTAAASAVSIQHLARPDAKVIGMIGAGHQA TFQLRAALEQRPFEKVIGWNLHPEMLPNLAAVAEEAGLPFEAVELDGMTEADVIITITSSFAPSLLAQHVSP GTHIACMGTDTKGKQELEAALLGSATVFADEIDQSITLGEAQHAIATGLISRDDITEIGAVINGTHPGRSSAE EITLFDGTGVGLQDLAVAAAVVDLAVEQGVAIEVDF |

FIG. 12AA

| | |
|---|---|
| 326 | MYIVPEREIAGLMTREASFAAVEKVFAAMAAKDAYNFPVIREAIGHEDALYGFKGGFDRAGQTLGLKAGG YWPNNLEKRGLINHQSTVFLFDPDTGKASAMVGGNLLTALRTAAASSVSISHLARKDAKVIGMIGAGHQA KFQLRAALEQREFEKVIGWNLHPEMLPNLQEVADEAGLPFEAVELDGMREADVIISITSSFDAILGADQVS PGTHLACMGTDTKGKQEVDPALLVKATVFTDEVAQSISIGEAQHAIAQGLIGEGDIAQLGAVINKAHPGRQ SDEEVTLFDGTGVGLQDLAVASAVVDQAVKTGIAIEVDF |
| 327 | MWIVPEREIADLLTRDASFEAVENVFAAMAAGDAYNFPVIREAIGHEDALYGFKGGFDGVGGTLGLKAGG YWPHNLEKRGLINHQSTVFLFDPDTGKVAAMVGGNYLTALRTAAASSVSIKHLARADAKVMGMVGAGHQ ATFQLRAALEQRAFEKVIGWNYHPEMLPNIEKVANEAGVPFEAVELDGLGEADVVISITSTFAPTIMAEHIS AGTHIACMGTDTKGKQEVEAALLARASVFTDEVAQSVSIGEAQHAIAERLIAVSDVTQIGAVINGTHEGRT SEEEITLFDGTGVGLQDLAVSAAIVRMAIEQGVAIEVDF |
| 328 | MIIVPEHEIESLVSASDCFTAVERVFASMAQKSAYNFPVIREAIGHADALYGFKSGFDRESLALGLKSGGF WPNNIEKGLTNHQSTIFLFDADTGKCRAVVGGNLLTALRTAAASAVSIKYLARPDAKVLGMVGAGHQSTF QLRAALEQRAFEKVVGWNIYPEALDRLAKIAAEHDVPFEAVDLDRLGAEADVIITITSAFAPILKAAQIRRGT HLACMGTDTKGKQEVEAELLAAATIFSDEIAQSVTIGEAQHPVARGLISPDRITEIGAVINGAHPGRTNADEI TVFDGTGVGLQDLAVASKAVDLAVQKGVAVVVDF |
| 329 | MYVVAEKEIAGLMNPEAAFEAIEAVFAAMARRKAYNFPVVREAIGYEDALYGFKGGFDASGLALGLKAGG YWPNNQKHGLINHQSTVFLFDPDTGRVSAAVGGNLLTALRTAAASAVSIKYLAPIGAKVLGMIGAGHQSA FQMRAAANVHGFEKVIGWNPHPEMLSRLADTAAELGLPFEAVDLPQLGEEADVIISITSSFSPLLLNEHVK GPTHIAAMGTDTKGKQELDPALVTRARIFTDEVAQSISIGECQHAIAAGLIKEEQISELGAVVTGDNPGRAD AEVTLFDGTGVGLQDLAVAQKVLEIAKEKGIAQQVEI |
| 330 | MYIVPEKAIADLVTREASFDAVEKVFAAMAAGDAYNFPVVREAIGHEDALYGFKGGFDRAGLTLGLKAGG YWPNNLEKRGLINHQSTVFLFDPDTGKVKAMVGGNLLTALRTAAASSVSIKHLARQDAKVIGMIGAGHQA KFQLRAALEQRSFEKVIGWNLHPEMLPNLQEVADEAGLPFEAVELDGMREADVIISITSSFDAILKADQVS PGTHVACMGTDTKGKQEVDPQLLVAADVFTDEVAQSVSIGEAQHAIAQGLIQKGDVAQIGAVINGINPGR TSDDQITLFDGTGVGLQDLAVAASVVDVAVEKGIAIEVDF |
| 331 | DALYGFKGGFDSAGLSLGLKAGGYWPNNLEKRGLINHQSTVFLFDPDTGKVRAMVGGNLLTALRTAAAS SVSIKHLAREDAKVIGMIGAGHQAKFQLRAALEQRDFDKVIGWNLHPEMLPNLKEVATEAGLPFEAVELD GLKEADVIISITSSFDAILKADQVSPGTHIACMGTDTKGKQEVDPQLLVRATVFTDEVAQSISIGEAQHAVA QGLITEADVAQLGAVINGAHPGRSSAEQITLFDGTGVGLQDLAVAASVVELAVKKGVAIEVDF |
| 332 | MLIVPEREIADLMTREAAFEAVEKVFAAMAAGDAYNFPVVREAIGHEDALYGFKGGFDRAGLTLGLKAGG YWPNNLDKRSIINHQSTVFLFDPDTGKARAMVGGNLLTALRTAAASSVSIRHLARKDAKVIGMIGAGHQAK FQLRAALEQRGFEKVIGWNLHPEMLPNLEEVASEAGLPFEAVELDGMTEADVIITITSSFGAILSAGQVSP GTHVACMGTDTTGKQEVEPALLGHATVFTDEVAQSVSIGEAQHAVSQGLIAESDIAQLGAVINGSHPGRI SDHQITLFDGTGVGLQDLAVAAAVVDLAVEKGIAIEVDF |
| 333 | MSEANSVNSDEGLLIVSEDACKSVIDRPSAFIAVENVFASMSRGDAYNFPVIREAIGYADALYGFKSGFDR AGKSLGLKSGGYWPGNAAKGLTNHQSTIFLFNPDNGKLRALVGGNYLTAVRTAAASAVSIAHLARKDSKV LGMVGAGHQSTFQLRAALEQRNFEKVVAWNKNKDRLKNLQAVAEELGVPFEAVEREQLCSEADVIITITS AFEPLLMKEWIKPGTHIACMGTDTVGKQEVDVNLVAAATVFTDEIAQSISLGEAQHAIKSGAIKESDITTLG DVINGDHPGRSSDDEITLFDGTGVGLQDLAVASAAAKLALELEKGEAQHISL |
| 334 | MIIVPENQIAGLITPADCLVAVEGVFASMAKRSAYNFPVIREAIGHADALYGFKSGFDRDSLALGLKSGGF WPNNVQKGLANHQSTVFLFDADTGRCRAMVGGNLLTALRTAAASAVSIKYLARKDAKVLGMIGAGHQST YQLRAAVEQRPFEKVLAWNLHPEMLSRLEGVARELELPFETVDLDRLGDESDVIISITSSFAPILKASQVRP GTHLACMGTDTKGKQEMDAELIAAATVFADEVAQAITIGECQHAIEKGLISRDDIVEIGAVITGRHPGRSSP EEITLFDGTGVGLQDLAVASAAVELALSNGTAIEVDF |
| 335 | MMNTHVETTADGFVIVGEEICQKIISRADAFGAVEAVFAAMARGDAYNFPVVREAIGHADALYGFKGGFD RSGLSLGLKAGGYWPGNMDKGLTNHQSTVFLFDPDTGRLSALVGGNYLTALRTAASSSVSIAHLAREDS KVLGMVGAGHQSAFQLRAAVEQRSFEKVVAWNPHPDMLPRLGAVAEELGLEFEAVTQEELGAQADVIITI TSAFEPLMMADWVKPGTHIACMGTDTKGKQEVDPALFTRATVFADEIAQSVSIGEAQHAVAQGLISEGDI TPIGAVINGTHAGRASAEEVTLFDGTGVGLQDLAVASVAAKLARDQGLVTPITLG |
| 336 | MIIVPETEIAGLVTAADCFKAVEGVFASMANKSAYNFPVVREAIGHADALYGFKSGFDRKGLALGLKAGGF WPNNVHRGLTNHQSTVFLFDPDTGKCRAVVGGNLLTALRTAAASAISIKYLARKDAKVLGMIGAGHQATF QLRAALAQRQFEKIVGWNLHPDMLSRLEEVAKEEGLPFEAVDLDRLGAEADVIISITSSFAPMLKASQVRA GTHLACMGTDTKGKQEIEAEILVKATVFTDEVAQAVTIGESQHAIERGLIREEAIVEIGAVINGTHPGRISAD QITLFDGTGVGLQDLAVASAAVELALAKGVAIEVDF |
| 337 | MIIVPETEIAGLVTPADCFRAVEGVFASMADKSAYNFPVIREAIGHADALYGFKSGFDRKGLALGLKAGGF WPNNVHRGLTNHQSTVFLFDADTGKCRAVVGGNLLTALRTAAASAISIKYLARKDAKVLGMIGAGHQATF QLRAALAQRSFERIVGWNLHPDMLSRLEEVAKEEGLPFEAVDLDRLGAEADVIISITSSFAPMLKASQVRA GTHLACMGTDTKGKQEVEAEILAAAAVFTDEVAQAVTIGESQHAIERGLIREEAIVEIGAVINGTHPGRTSA DQITLFDGTGVGLQDLAVASAAVELALAKGVAIEVDF |

FIG. 12AB

| 337 | MIIVPEHAIDGLLTEAECFTAVEQVFASMARRRAGNFPVVREAIGHADALYGFKSGFDRDSLALGLKAGGF WPGNAAKGLTNHQSTVFLFDADTGRCRAVVGGNLLTALRTAAACAISVRHLARKDARVLGMIGAGHQSA FQLRAALAQRPFERVLAWNLHPGMFGRMEAVAREHGVPFEAVDLDRLGAEADVVVTITSSFAPILKAAQV RPGTHLACMGTDTRGKQEVEAELLAGATVFTDEVAQSVSIGEAQHAVTRGLLAADSIVEIGAVINGDHPG RVSESEITLFDGTGVGLQDLAVAAVAVDRAVAKGLATEVDV |
|---|---|
| 339 | MIIVPENQIAGLITPADCLVAVERVFASMAEKSAYNFPVIREAIGHADALYGFKSGFDRDSLALGLKSGGFW PHNVEKGLANHQSTVFLFDADTGRCRAMVGGNLLTALRTAAASAVSIKYLARKDAKVLGMIGAGHQSTY QLRAAVEQRPIEKVLAWNLHPEMLSRLEEVARELELPFETVDLDRLGAEADVIISITSSFAPILKASQIRPGT HLACMGTDTKGKQEVDPELVAAATVFTDEVAQAVTIGECQHAIDKGLISKDDIVEIGAVITGRHKGRSSSE EITLFDGTGVGLQDLAVASAAVELALSKGAAIEVDF |
| 340 | MLIVPEREIANLMTREAAFDAVEKVFAAMASDDARNFPVVREAIGHEDALYGFKGGFDRAGLTLGLKAGG YWPHNLEKHELINHQSTVFLFDPDTGRAKAMVGGNLLTALRTAAASSVSIKHLAREDAKVIGMIGAGHQA TFQLRAALEQRRFEKVIGWNYHPEMLPNIEKVATEAGLPFEAVDLPGMAEADVIITITSAFAPSLMADHVS PGTHIACMGTDTKGKQEVETALLGRATVFTDEVAQSISIGEAQHAIQDLSLRPEDIIQLGRVINGSHEGRTS DDEITLFDGTGVGLQDLAVAAAVVDLAVEKGISIEVDF |
| 341 | MFVVAEKEIAGLMTPEAAFEAIEAIFASMARRKAYNFPVVREAIGHEDALYGFKGGFDASALTLGLKAGGY WPNNQKHNLINHQSTVFLFDPDTGRVSAAIGGNLLTALRTAAASAVSIKYLAPQGAKVLGMIGAGHQSAF QMRAAAAVHQFEKVIGWNPHPEMLGRLAETAADLGLPFEAVELDRLGAEADVIISITSSFSPLLMNEHVK GPTHIAAMGTDTKGKQELDPALVARARVFTDEVAQSVSIGECQHAIAAGLIAEDQIGELGAVVAGDDPGR GDAEVTIFDGTGVGLQDLAVAAKVLEIAKEKGVAQTVEI |
| 342 | MLIVPEREIADLMTREAAFAAVEKVFAAMAAGDAYNFPVVREAIGHEDALYGFKGGFDRSGLTLGLKAGG YWPNNLEKRGIINHQSTVFLFDPDTGKARAMVGGNLLTALRTAAASSVSIRHLAREDARVIGMVGAGHQA TFQLRAALEQRDFDKVIGWNLHPEMLPNLEKVAAEAGVPFEAVELTGMREADVIISITSSFDAILMAEHVS PGCHIACMGTDTKGKQEVSPALLAKATVFTDEVAQSVSIGEAQHAVAQGLIDESAITQLGAVINGAHPGR RSAEEITLFDGTGVGLQDLAVAAAVVDLAVEKGIAIEVDF |
| 343 | MIIVPEREIADLMTREAAFEAVERVFAAMAAGEAYNFPVVREAIGHEDALYGFKGGFDRSGLTLGLKAGG YWPHNLAKRGVINHQSTVVLFDADTGRVHAMVGGNLLTALRTAAASAVSIRYLAREDARVLGMIGAGHQ AAFQLRAALEQRRFEKVIGWNLNPEMLPNLEKVAEEAGVPFEAVELGGMREADVIISITSSFEAILGADQV SPGTHVACMGTDTKGKQEVAPGLLARAVVFTDEVAQSVSIGEAQHAVAMGLIGEGDVQQLGAVINGAHP GRRSAEEITLFDGTGVGLQDLAVASRVVELAQEAGRAVMVDF |
| 344 | MIIVPEAVIADLITPEASFTAVERVFASMAARSAYNFPVIREAIGHADALYGFKSGFDRAALNLGLKSGGYW PGNAAKGLTNHQSTVFLFDADTGKCRAVVGGNLLTALRTAAAAAVSVAHLARPDAKVLGIVGAGHQAAF QLRAVAAQRPFEKIVAWNRSPEKLETLRGVADELGLGFESVSIEDLGGQADVIVTITSSHDAILHGAQVKP GTHVACMGTDTKGKREVDNDLIAAATLFTDEVAQSTTIGECQHAIVDLTIRPEDITELGAVINGDHKGRTSA EEITLFDGTGVGLQDLAVASAVVELAMSRGVATEVDF |
| 345 | MIIVPERAIADLIGSAECFTAVEQVFAAMARKSAYNFPVVRESIGYADALYGFKSGFDRESLSLGLKSGGF WPKNVEKGLTNHQSTVFLFDADTGRCRAVVGGNLLTALRTAAASAISIKYLAREDAKTLGIIGAGHQSTFQ LRAAVEQRNFEKVVAWNYHPEMLNRLAEVAREIGLPFEAVDLDRLGAEADVIISITSSFSPSLMAAQVRPG THLACMGTDTKGKQEVDAKLVAASSIFTDEVAQAITIGECQHAIADGLIGEADILEIGAVITGDVKGRRSAD DITLFDGTGVGLQDLAVAAAVVDLAVREGVAIEVDF |
| 346 | MLIVPEREIADLMTREAAFAAVEKVFAAMASGDAYNFPVVREAIGHEDALYGFKGGFDRAGLTLGLKAGG YWPNNLDKRGIINHQSTVFLFDPDTGKAKAMVGGNLLTALRTAAASSVSIRHLARKDAKVIGMIGAGHQA KFQLRAALEQRDFDKVIGWNLHPDMLPNLEEVAAEAGLPFEAVELDGMQEADVMISITSSFDAILSAGQV APGTHIACMGTDTKGKQEVDPQLLAKATVFTDEVAQSVSIGEAQHAVAQGLIAEGDIAQLGAVINGSHKG RASDEEITLFDGTGVGLQDLAVANAVVELAVEKGIAIEVDF |
| 347 | MIIVPEHEIEGLVSASDCFTAVERVFASMAQKSAYNFSVIREAIGHADALYGFKSGFDRESLALGLKSGGF WPNNMEKGLTNHQSTIFLFDADTGKCRAVVGGNLLTALRTAAASAVSIKYLARPDAKVLGMVGAGHQSS FQLRAALQQRPFEKVIGWNLFPEALDRLAKVAAEHDVPFEAVDLDRLGAEADVIITITSSFAPILKAAQIRP GTHLACMGTDTKGKQEVEAELLAAATIFSDEIAQSVTIGEAQHPVAKGLISPNRIIEIGAVINGAHPGRSNA DEITVFDGTGVGLQDLAVASKAVDLAVQKGVAVVVDF |
| 348 | MYIVPEKAIADLVTREASFDAVEKVFAAMAAGDAYNFPVVREAIGHEDALYGFKGGFDRAGLTLGLKAGG YWPNNLEKRGLINHQSTVFLFDPDTGKVKAMVGGNLLTALRTAAASSVSIKHLARQDAKVIGMIGAGHQA TFQLRAALEQRQFEKVIGWNYHPEMLPNIEKVAAEAGLPFEAVDLPGMTEADVIISITSAFAPSLMADHVS PGTHIACMGTDTKGKQEVEAELLVKASVFTDEVAQSISIGEAQHAVAQGLIQESDVAQIGAVINGTNPGRT SDDQITLFDGTGVGLQDLAVAASVVEVAVEKGIAIEVDF |
| 349 | MIIVPEHAIDGLLTEAECFGAVEQVFASMARRRAGNFPVVREAIGHADAIYGFKSGFDRDSLALGLKAGGF WPGNAAKGLTNHQSTVFLFDADTGRCRAVVGGNLLTALRTAAACAISIRHLAREGARVLGMIGAGHQSA FQLRAALAQRPFERVLAWNLHPGMFGRMEAVARERGVPFEVVDLDRLGAEADVVVTITSSFAPILKAAQV RPGTHVACMGTDTRGKQEVEAELLAAATVFTDEVAQSVSLGEAQHAVARGLLAADSIVEIGAVINGDHPG RVSDAEITVFDGTGVGLQDLAVAAVAVDRALAKGLATEVGF |

FIG. 12AC

| | |
|---|---|
| 350 | MLIVPEREIADLMTREAAFDAVEGVFAAMASKDAYNFPVIREAIGHEDALYGFKGGFDKAGMTLGLKAGG YWPNNLEKHGHINHQSTIFLFDPDTGMVSAMVGGNLLTALRTAAASSVSIKHLARKDAKVMGMVGAGHQ ATFQLRAALEQRQFEKVIGWNYHPEMLPNIEKIANEAGLPFEAVELEGMREADVVISITSTFAPTIMADHIA PGTHIACMGTDTKGKQEVEAALLARATVFTDEVAQSVSIGEAQHAVAQGLIKESDVHQLGAVINGTDKGR ASDDEITLFDGTGVGLQDLAVAASVVELAVQKGVAIDVDF |
| 351 | MLIVPEREIANLMTRDAAFDAVEGVFAAMASKDAYNFPVIREAIGHEDALYGFKGGFDKAGMTLGLKAGG YWPNNLEKHGHINHQSTIFLFDPDTGMVSAMVGGNLLTALRTAAASSVSIKHLARKDAKVMGMVGAGHQ ATFQLRAALEQRQFEKVIGWNYHPEMLPNIEKIANEAGLPFEAVELEGMREADVVISITSTFAPTIMADHIA PGTHIACMGTDTKGKQEVEAALLARATVFTDEVAQSISIGEAQHAVAEGLIKESDVHQLGAVINGTHKGRT SDDEITLFDGTGVGLQDLAVAASVVELAVQKGVAIEVDF |
| 352 | MSNEKDGSVVIVTEEICQKVVDRASAFTAVEQVFGAMAKGDAYNFPVIREAIGYADALYGFKSGFDRVGG SLGLKSGGYWPGNAEKGLTNHQSTVFLFDPDTGRLQALVGGNYLTAVRTAASSSVSIAHLARKDAKVLG MVGAGHQSAFQLRAAAEQRDFERVVAWNPHPDMLPKLGEVAKDLGLDFEAVSQEELGAQADVIITITSA FEPLLMADWIKPGTHIACMGTDTKGKQEVDAALLARATVFTDEIAQSISIGEAQHAVGQGLIAEGDITPIGA VINGDHKGRTSEDEITLFDGTGVGLQDLAVASVAAKLARERGMAQTVML |
| 353 | MFIVPEKEIAGLVSADQCFEAVEAVFAAMARGDAYNFPVIREAIGHAEALYGFKSGFDRAGSVLGLKSGG YWPGNAAKGLTNHQSTVVLFDPDSGRPAALVGGNLLTALRTAAASAVSIRYLARSDARVLGVLGAGHQS AFQLRAAVAQRRFEKIVGWNYHPEMLPRLAETAAELGLPFEAVSLEDLGAQADVIVTISSSFSAQLMDAH VRPGTHLACMGTDTKGKQEIDPAIFARARVFADEIAQSVEIGEAQHAVAAGLIAAEDIVEIGAVINGTAPGR QSDDEITVFDGTGVGLQDLAVAARAVAAARARGLAVEVDL |
| 354 | MSKGLLIVGEDICAEVVSSADAFTAVEAVFGAMAKGDAYNFPVIREAIGYADALYGFKSGFDKAGKTLGVK SGGYWPGNMDKGLTNHQSTIFLFDPDTGMLEALVGGNYLTAVRTAASSSVSIAHLARKDAKVLGMVGAG HQSTFQLRAAAEQRDFEKVVAWNPHPDMLPRLGAVAEELGLAFEAVTQEELGAQADVIITITSAFEPLLM KDWIKPGTHIACMGTDTKGKQEVDPELLVSATVFADEIAQSVTIGEAQHAVASGRLSDAEITPIGAVINGTH AGRSSDQQITLFDGTGVGLQDLAVASVAAREAESRGKATRIAL |
| 355 | MYIVPEKEIAGLMTREAAFDAVEKVFASMASGDAYNFPVVREAIGHEDALYGFKGGFDRAGLTLGLKAGG YWPNNLEKRGLINHQSTVFLFDPDTGKAKAMVGGNLLTALRTAAASSVSIKHLARKDAKVIGMIGAGHQA KFQLRAALEQREFEKVIGWNLHPDMLPNLQEVADEAGLPFEAVELDGMREADVIISITSSFDAILNAGQVS PGTHIACMGTDTKGKQEVDPQLLVAADVFTDEVAQSITIGEAQHAVAQGLIQEADVAQIGAVINGTNPGRT SDDQITLFDGTGVGLQDLAVAASVVDLAVAQGIAIEVDF |
| 356 | MYIVPEAKIADLVSREASFEAVEQVFAAMASKDAYNFPVVREAIGHEDALYGFKGGFDRVGGSLGLKAGG YWPHNLEKRGLINHQSTVFLFDPDTGRVHAMVGGNLLTALRTAAASSVSIKHLAREDAKVMGMIGAGHQ ATFQLRAALEQRSFEKVIGWNYHPEMLPNIEKVAQEAGLPFEAVELEGMREADVIISITSAFSPSLMADHV SEGTHIACMGTDTKGKQEVEAALLAKAKVFTDEVAQSISIGEAQHAVGSGLIAESDVIEIGAVINGAHPGRT SDSDITLFDGTGVGLQDLAVASKVVELAIERGVAIEVDF |
| 357 | MIIVPEKEIAGLIGRVEAFEAVENVFAAMSSGAAYNFPVIREAIGHADALYGFKSGFDRSSLALGLKSGGY WPGNADKGLTNHQSTVFLFDADTGQAKAVVGGNLLTALRTAAASAVSIKHLAREDAKVLGMIGAGHQSA FQMRSAVEQRKFEKVIGWNFHPEMLSRLEETATELGLPYESVDLDRMGTEADVIISITSSFDPILMADQVT QGTHIACMGTDTKGKQEVDTGLVARATLFTDEVAQSATIGECQHAVAAGIVSRDNINEIGAVINGTHSGRT SESEITLFDGTGVGLQDLAVASAAVELAVQKGVAIEVAF |
| 358 | MWIVPEREIAGLVSREAAFDAVEQVFAAMAAGRANNFPVVREAIGHENALYGFKGGFDQLGGALGLKAG GYWPNNLEKRGLINHQSTVFLFDPDTGRPVAMVGGNLLTALRTAAASSVSIQHLSRPDARVIGMVGAGH QATFQLRAALEQRSFEKVIGWNRHPEMLPNIQKVAEDADLPFEAVELGDLSEADVIITITSSFGPILMVDHV APGTHIACMGTDTKGKQEVEARLLANSLVFTDEVAQSISIGEAQHAVASGALASDAVIEIGRVINGDHPGR QSADEITLFDGTGVGLQDLAVAAKVVDLAIEKGVAIKVDI |
| 359 | MIIVPEREIADLMTREAAFEAVERVFAAMAAGEAYNFPVVREAIGHEDALYGFKGGFDRSGLTLGLKAGG YWPHNLAKRGVINHQSTVVLFDADTGRVHAMVGGNLLTALRTAAASAVSIRYLAREDARVLGMIGAGHQ AAFQLRAALEQRRFEKVIGWNLPPEMLPNLEKVAEEAGVPFEAVELGGMREADVIISITSSFEAILGADQV SPGTHVACMGTDTKGKQEVAPGLLARAVVFTDEVAQSVSIGEAQHAVAMGLIGEGDVQQLGAVINGAHP GRRSAEEITLFDGTGVGLQDLAVASRVVELAQEAGRAVMVDF |
| 360 | MYIVPESAIADLISAEASFDAVEAVFASMAKGDAYNFPVIREAIGHEEALYGFKGGFDGKMALGLKAGGY WPHNLEKRGLINHQSTVFLFDPDTGRVASMVGGNLLTALRTAAASSVSIKHLARKDARVMGMIGAGHQA KFQLRSALQTHAFEKVISWNYHPEMLPGMAEVAAEFDLPFEEVQLEGMTEADVVISITSSFAPIFGPDHIA PGTHVACMGTDTIGKQECEAELLARATVFTDEVAQSISIGEAQHAVKAGLIMETEVNQIGDVINGVHKGRS SDDEITLFDGTGVGLQDLAVAQSVVEIAVERGVAIEVDF |
| 361 | MLIVPEREIASLMTRDAAFAAVEKVFAAMAAGDAYNFPVVREAIGHEDALYGFKGGFDRSGLTLGLKAGG YWPNNLATRGIINHQSTVFLFDPDTGKAKAMVGGNLLTALRTAAASSVSIRHLAREDARVIGMVGAGHQA TFQLRAALEQREFDKVIGWNLHPEMLPNLEKVAAEAGVPFEAVDLPGMREADVIISITSSFDAILMAEHVS PGCHIACMGTDTKGKQEVSPALLAKATVFTDEVAQSVSIGEAQHAVAQGLIDESAITQLGAVINGAHPGRA SAEEITLFDGTGVGLQDLAVAAAVVDLAVEKGIAIEVDF |

FIG. 12AD

| | |
|---|---|
| 362 | MFVVSEEVCRKVVSRADAFDAVQAVFAAMARGDARNFPVVREALGHADALYGFKSGFDRAGLALGVKS GGYWPGNAQKGLTNHQSTVFLFDPDTGQLQALVGGNYLTAIRTAAASAVSIAHLARKDARVLGMIGAGH QAQFQLRAAAEQRQFEKVIAWNLHPEKLSILEAVATELGLPFEAVGRQQLAEQADTIITITSAHEALLDSG WIRPGTHIACMGTDTAGKQELDPQLFSDASVFTDELAQSITIGEAQHAFKAGQLQEADITALGAVINGDHP GRVTDDEITVFDGTGVGLQDLAVAAVALRVACEEGDAKEIAL |
| 363 | MLIVPEKDIADLMTRDAAFDAVEQVFAAMASDDAYNFPVVREAIGHEDALYGFKGGFDRAGATLGLKAGG YWPHNLEKRDLINHQSTVFLFDPDTGKPAAMVGGNLLTALRTAAASSVSIKHLARPDAKVLGMIGAGHQA TFQLRAALEQRAFDRVIGWNYHPDMLPNIAKVAEDAGLPFEAVDLPGMAEADVIISITSAFAPSLMADHVS PGTHIACMGTDTKGKQEVEAALLARATVFTDEVAQSISIGEAQHAIAAGLIAESDIHQIGAVINGAHPGRTS DTDITLFDGTGVGLQDLAVAARVVDLAQKKGIAIHVDF |
| 364 | MSFQNPVFIPGPTNIPESLRKACDMPTIDHRSPLFGQILHPARAGVRAVLKSETAEIFIFPSTGTGGWETAL TNTLSAGDGVLAARNGMFSHRWIDMCQRHGLAVEVVETPWGEGLPADRYEEILAADTHHRIKAVLATHN ETATGVRSDIAAVRRALDKAGHPALLFVDGVSSIGSMDFRFDEWRVDVAVTGSQKGFMLPAGLAIVGFSA KAMEATATGTLPRTFFDVHDMARGYANNAYPYTPAVGLMNGLNQACRMLLDEGLENVFARHHRIAEGV RAAVHAWGLELCAASPDLYSDTVSAIRTPEGFNATDIVTHAASKYGVAFGVGLGEVAGKVFRIGHLGSLT DVMTLSGIATAEMCMADLGLDIGLGSGVAAAQEYFRSHSATSLLAAA |
| 365 | MSFQNPVFIPGPTNIPESLRKACDMPTIDHRSPLFGQILHPAREGVRKVLKSDSAEVFIFPSSGTGGWETA LSNTLSPGDTVLAARNGMFSHRWIDMCQRHGLEVEIIETPWGEGLPADRYEEILTADTSHKIKAVLATHNE TATGVKSDIAALRRALDAAAHPALLFVDGVSSIASMDFRMDEWGVDVAVTGSQKGFMLSAGLAIVGFSAK AMDATQSARLPRTFFDVHDMAKGYANNAYPYTPAVGLMNGLNESCKMLLAEGLEDVFARHHRIAEGVR AAVGAWGLELCAATPEVYSDTVSAIRTPEGFNATDIVTHAAEKYGVAFGVGLGEVAGKVFRIGHLGSLTD VMALSGIATAEMCMVDLGLDIRLGSGVAAAQDYYRGHTAAAQKDAA |
| 366 | MSFQNPVFIPGPTNMPESIRKACDMPTIDHRSPLFGQILHPARANVQKVLKSANADVFIFPSTGTGGWET AITNTLSAGDTVLAARNGMFSHRWIDMCQRHGLDVQIVETPWGHGLPADRYAEALAADKGHKIKAVLAT HNETATGVKSDIAAVRAALDAADHPALLFVDGVSSIGSMNFEFDAWGVDIAVTGSQKGFMLPAGLAILGF SAKARAATKTAGLPRTFFDVNDMAKGYDNSAFPYTPPVGLMNGLLLASDMLLREGLDNVFARHTRIASGI RAAVHAWGLELCAATPDLYSDTVSAIKTPAGFNATEIVNHAASAYGVAFGTGLGEVAGKVFRIGHLGSMT DVMALSGIATAEMCMVDLGLDIKLGSGVAAAQDHYRRTTGQALQDAA |
| 367 | MSEQNPVFIPGPTNIPNRLLNAMHIQTQDHRSPNFVETLTPVLEGCKKVFGTTTGEVITFPSTGTGGWEA AISNTLSAGDKVLIARYGMFSHRWIDLCQRHGLEVVVIECPWGDGAPADLFEEALNADNNHDIKAVLVTH NETATGVRSDIAGVRKAMNNVNHPAMLFVDCVSSLASMPFEMDAWEVDIAISGSQKGFMLTTGMAILGV SQKALAAMETANLPRTFFDFRDMMGANANGGFPYTPPLQLIFGMKESLDMLFDEGLENVYARHFRLAEG VRQAVAAWGLKLCANTPELASDSVSAIYVPEGFDSNELTAHAFDKYGVSFGIGLGEMNGKAFRIGHLGSL TDVMVLSGLATIEMAMADLDYPIQLGAGVAAAQEYFRKTAKKANA |
| 368 | MTSQNPIFIPGPTNIPEEMRKAVDMPTIDHRSPVFGRMLHPALEGVKKVLKTTQAQVFLFPSTGTGGWET AITNTLSPGDKVLAARNGMFSHRWIDMCQRHGLDVTFVETPWGEGVPADRFEEILTADKGHEIRVVLATH NETATGVKSDIAAVRRALDAAKHPALLFVDGVSSIGSMDFRMDEWGVDIAVTGSQKGFMLPPGLAIVGFS PKAMEAVETARLPRTFFDIRDMATGYARNGYPYTPPVGLINGLNASCERILAEGLENVFARHHRIASGVRA AVDAWGLKLCAVRPELYSDSVSAIRVPEGFDANLIVSHALETYDMAFGTGLGQVAGKVFRIGHLGSLTDA MALSGIATAEMVMADLGLPIQLGSSGVAAAQEHYRQTTAAAQKKAA |
| 369 | MSDQNPVFIPGPTNIPDRLRAAMQVQTRDHRAPDFVDTFAPVLQDTKKVFGTTSGRVITFPASGTGGWE AALCNTLSPGDKVLVARYGMFSHRWIDMCERHGLDVQVIECPWGTGAPADKFEASLSDDKSHAIKAVLV THNETATGVKSDVAGVRAAMDASAHPALLFVDCVSSLASMPFEMDAWGVDIAVSGSQKGFMLATGMAIL GVSEKALAAMQTASLPRTFFDFRDMMGANASGGFPYTPPLQLIYGMRESLKMLFEEGLDNVYARHTRLA EGVRCAVKAWGLELVAQNPSLYSDTVSAIYVPEGFDSNALTDQAFNQYGVSFGVGLGEMNGKAFRIGHL GSLTDVMVLSGLATIEMAMADLDYPIELGSGVAAAQEHFRSKSGAAIKSAA |
| 370 | MSMQNPVFIPGPTNIPDELRRVIDFGTIDHRSSVFDEMLAPAIAGVKRILKTTDGEALVFPSTGTGAWEAAI SNTLSPGDKVLVGCWGMFSHRWIDMCERHGLNVIVAEANWGDGVPLNAYAAALEGDTGHAIKAVLATH NETATGVKSDISAVRAVMNKAKHPALLMVDGVSSIASMDFRMDEWGVDLAIAGSQKGFMLPPGLAILGIS QKAIAAMETAKLPRTFFDFRDMLTANGNGSFPYTPPVQLIRGLDHAIAMLESEGLDAVFARHARLAQGVR EAVNAWCLKLCATSPDLYSDTVSAVLVPDGFDGTKVVTHAAEKYGVAFGVGLGEVSGKLFRIGHLGMLT DVMMCAGLSTAEMTMLDLGFPIKAGSGVTAAQEYYRNNPVATAQPMDKAA |
| 371 | MFDQNPIFIPGPTNVPDRLRRVMDMQTRDHRSPAFGAMLPELFDGVRKVFNTKDAAIITFPASGTGGWE AAVSNTLSPGDTVLIARYGMFSHRWIDLCQRHGLNVEIIECAWGSGAPADLFAERLKADKGHEIKAVLVTH NETATGVRSDIGAVRRGMDSADHPAMLMVDCVSSLASMPFDFDGWGVDVAITGSQKGFMLFTGMCIVA VSQKALEHRKTAKLPRTFFSFDDMLAANGAGGYPYTPPIQLMFGLQESLKMLFEEGLENVYARHFRLAE GVRRAVDAWGLRLCAESADLYSDTVSAIYVPKGFDSNALTQHAYDAYDISFGVGLGEMNGRAFRIGHLG ALTDVTMLSGLATIEMAMADLDYPIELGSGVAAAQQFYRTTAGASLAKAA |

FIG. 12AE

| 372 | MSFQNPVFIPGPTNMPEAIRQACYMPTIDHRSPLFGKILHPMLDGVRRVLKSETAKIFVFPSTGTGGWETA<br>LSNCLNAGDKVLAARNGMFSHRWIDMCQRHGLDVHIVETPWGHGLPATEYEAILKADKNHAIKVVLATHN<br>ETATGVKSDIAAVRKALVAAGHPAMLFVDGVSSIGSMDFRMDEWGVDVAVTGSQKGFMLPAGLAIVGFS<br>DRAMQATKTSTLPRTFFDVHDMQKGYDNDAFPYTPPVGLMNGLKLALEMIEDEGLENVFARHRRIATGV<br>RHAVKAWGLELCAVSPDVYSDTVSAVKTPDGFNATDIVTRAADKYGMAFGVGLGEVAGKVFRIGHLGML<br>TDAMMLSGLGVAEMVMVDLGLDIKLGSGVAAAQEFYRHGV |
| --- | --- |
| 373 | MSFQNPVFIPGPTNMPEALRKAVDMPTLDHRSPLFGQILHPALAGVKKVLKSETAEIFVFPSTGTGGWET<br>AITNTLNAGDKILAARNGMFSHRWIDMCQRHGLDVQVVETPWGAGIPADRYEEILTADKAHEIKVVLATHN<br>ETATGVKSDIAAVRRALDAAGHPALLFVDGVSSIASMDFRMDEWGVDIAVTGSQKGFMLPPGLAITGFSP<br>KAMKAAETATLPRTFFDIKDMAKGYANSAYPYTPSVGLLNGLNMACGMLLDEGLENVFARHHRIAEGVR<br>AAVRAWGLELCAVSPEVYSDSVSAIRTPEGFDANTFVSLAAEKYGVAFGTGLGEVAGKVFRIGHLGSLTD<br>VMALSGIATAEMVMADLGLGIQLGSGVAAAQDYYRGNTASSAKAAA |
| 374 | MTSQNPIFIPGPTNIPEEMRKAVDMPTIDHRSPVFGRMLHPALEGVKKVLKSTQAEVFLFPSTGTGGWET<br>AITNTLSPGDKVLAARNGMFSHRWIDMCQRHGLDVTFVETPWGEGIPADRFEEILTADKGHEIRVVLATH<br>NETATGVKSDIAAVRRALDNAKHPALLFVDGVSSIGSMDFRMDEWGVDIAVTGSQKGFMLPPGLAIVGFS<br>PKAMAAVETARLPRTFFDIRDMAQGYARNGYPYTPPVGLINGLNASCERLLSEGLENVFARHHRIAGGVR<br>AAVEAWGLKLCAVRPELYSDSVSAIRVPEGFDANLIVSHALETYDMAFGTGLGQVAGKVFRIGHLGSLTD<br>AMALSGIAVAEMVMADLGLPIKLGSGVAAAQEHYRQTTATALKKAA |
| 375 | MISQNPVFIPGPTNMPEALRRAVDIPTIDHRSAEFGRILHPALEGVKKVLKTKDAQVFVFPSTGTGGWETAI<br>SNTLSAGDKVLAARNGMFSHRWIDMCQRHNLDVTIVETPWGEGIPADRFEEILSADKGHEIRVVLATHNE<br>TATGVKSDIAAVRRALDAAGHPALLFVDGVSSIGSMDFRMDEWGVDIAVTGSQKGFMLPPGLAITAFSPK<br>AMAAVESARLPRTFFDIRDMASGYARNGYPYTPPVGLINGLNESCKLLLAEGIDNVFARHRRIAEGVRKAV<br>HAWGMELCAARPELYSDSVSAIKFPAGFDGNRFVSHAMDQYQVAFGTGLGEVAGKVFRIGHLGSLTDA<br>MALLAISVAEMCLADMDLPVQLGSGVAAAQEHYRQTAGAALRKAA |
| 376 | MYMQNPVFIPGPTNMPEILRKAADMPTLDHRSPLFGEILRPALAGVKRVLKTEAASVYVFPSTGTGGWET<br>AITNTLSPGDRVLAARYGMFSQRWIDMCQRHGLKVDIIEAAWGGGAPADRYEEILAADTAHEIKAVLVTH<br>NETATGVKSEIAAVRRAIDAARHPALLFVDGVSSIASMDFRMDEWSVDIAVTGSQKGFMLPAGLAITAFSP<br>KALAAVETAKLPRTFFDIRDMARSYANNAYPYTPAVGLLNGLKLSTELLLAEGLENVFARHRRIASGIRAAV<br>RAWGLELCARSEDLYSDTVSAIRTPEGFDATSIVAHAARIYDVAFGVGLGEVAGKVFRIGHLGSLTDVMAL<br>SGIATAEMVMVDLGLNIKLGSGVAAAQEYYREGRASKIQAAA |
| 377 | MSAQNPVFIPGPTNIPEEIRKACDIPTLDHRSPAFARMFKPAVAGIRRVLGMQQGEVIILPSTGTGGWEAAI<br>TNSLSSGDRILTARFGMFSHRWIDMCQRHGLDVQVIEAPWGMGIPLAEMEAALRADTSHSIKAVLATHNE<br>TATGVKSDIAGLRRALDAAGHPALLFVDGVSSIGSMPFDMAGWGVDIAVAGSQKGFMLPAGLAILGVSPK<br>ALRAMDSATLPRTFFDFRDMLKAYAAGGYPYTPAVGLIAGLAKSIEMLEDEGLSHVYARHHRLAEATRRA<br>VAAWGMSPCAATPDLYSDTVTAVVVPNGCDGTELVQLAATKYGVAFGVGLGEVAGKVFRIGHLGMLSD<br>VMLLSGLATAEMCMADLGWKVQLGSGVAAAQDYLRKSANAALAEAA |
| 378 | MSFQNPVFIPGPTNIPERLRKACDMPTIDHRSPLFGQILHPAREGVRRVLKSDSAQIFIFPSTGTGGWETA<br>LSNCLSAGDTVLAARNGMFSHRWIDMCQRHGLGVEIVETPWGHGLPADRYEEILTADTGHRIKAVLATH<br>NETATGVKSDIAAVRRALDAAGHPALLFVDGVSSIASMDFRFDDWGVDVAVTGSQKGFMLPPGLAITAFS<br>AKAMAATDTATLPRTFFDVKDMAKGYANNAYPYTPAVGLLNGLNEACGMLLAEGLDNVFARHHRIAEGV<br>RAAVRAWGLELCAVSPEVYSDTVSAIRTPEGFNATDIVSHAASAYGVAFGTGLGEVAGKVFRIGHLGSLT<br>DVMALSGLATAEMVMADLGLDIRLGSGVAAAQDYYRGCRIETRKAAA |
| 379 | MSDQNPVFIPGPTNIPDRLRRALQVQTRDHRAPDFVDTLAPVLSGIKTVLNTTDGNVVTFPSTGTGGWEA<br>AITNTLSPGDRVLVARYGMFSHRWIDLCQRHGLDVRIIETDWGAGAPADRFEEELRADTGHRIKAVLVTH<br>NETATGVLSDISAVRRAMDMAGHPALLFVDAVSSLASVPFRMDDWGVDIVVSGSQKGFMLTTGMAILGV<br>SPKALGAIETARLPRTFFDFRDMMGANARGGFPYTPPLQLIYGMRESLNMLFEEGLENVYARHNRLAEG<br>VRRAVDAWGLKLVAKSPELYSDTVSAIYVPDGFDSNALTDHAFHAYDVSFGIGLGEMNGRAFRIGHLGSL<br>TDVMVLSGLATIEMAMADLNYPIRLGSGVAAAQEYLRRPAQAAAKSAA |
| 380 | MISQNPVFIPGPTNMPEVLRKSCDMPTLDHRSAAFADILHPALEGVKKVLKTTSAEVFVFPSTGTGGWET<br>ALTNTLSPGDTVLVGRNGMFSHRWIDMCERHGLDVIVLDTAWGQGLPVDRYGEVLAQDTEHRIKAVLAT<br>HNETATGVVSDIAGLRAAMDASAHPALLLVDGVSSIGSMNFEMDAWGVDIAVTGSQKGFMLPAGLAIVGV<br>SQRALGAMATAKLPRTFFDLRDMQKGYAVNGYPYTPPVGLLNGLKLACDMLLEEGLENVFARHRRIADG<br>VRAAVAAWGLELCAERPEWQSDTVSAVRTPEGFDAGEIVTHAAEVYDMAFGVGMGEVAGKVFRIGHLG<br>MLTEAQALCGLATVEMCMVDLGLDIQLGSGVAAAQGVYRHGTRQQAMAAE |
| 381 | MSFQNPVFIPGPTNIPEALRRAVDMPTIDHRSALFAEILHPAREKVKAVLKSEAAEVFFFPSTGTGGWEVAI<br>TNTLCPGDRVLAARNGMFSQRWIDMCERHGLTVEVVETPWGDGIPADRFEEILTADAGHEIKAVLATHNE<br>TATGVTSDIAAVRRAMEAAGHPALLLVDGVSSIASMDFRMDEWGVDVAVTGSQKGFMLPAGLAIVGFSP<br>RAMAAVERATLPRTFFDIRDMGRSYAANGYPFTPAVGLLNGLNQSCDMLLAEGLEAVFARHHRIAEGVR<br>AAVRAWGLELCANAPELYSDSVSAIRTPEGVNATDIVTHAADVYGVAFGVGLGEVAGKVFRIGHLGSLTD<br>VMALSGIATAEMCMADLGMDVTLGSGVAAAQEVYRRSAGNGRREAA |

FIG. 12AF

| | |
|---|---|
| 382 | MSNQNPIFIPGPTNIPEVLRKAVDMPTIDHRSPVFGKILHPALEGVKKVLKSTQAEVFVFPSTGTGGWETAI TNTLSAGDKVLATRNGMFSHRWIDMCQRHGLDVQVVMQEWGEGVPADKFEEILTADKGHEIKVVLATH NETATGVRSDIAAVRRALDAAGHPALLFVDGVSSIGCYDFRMDEWGVDIAVTGSQKGFMLPPGLAIVGFS PKAMAAVETAKLPRTFFDIRDMAKGYAANGYPYTPPVGLLNGLNVACEMLLEEGLENVFARHHRIAEGVR KAVSAWGLQLCAARPELYSDSVSAIRVPEGFDANKVVSHALNTYGVAFGTGLGDVAGKVFRIGHLGSLT DVMALSGIATAEMVMADLGLPVQLGSGVAAAQEHYRQSVAGAQQKAA |
| 383 | VSTQNPIFIPGPTNIPEVLRKAVDMPTIDHRSPMFGKILHPALEGVKKVLKSTQAQVFFFPSTGTGGWETAI TNTLSAGDAVLATRNGMFSHRWIDMCQRHRLDVQVVDQPWGEGIPTDRFEEILTADTAHRIKAVLATHN ETATGVRSDIAAVRRALDRAGHPAMLFVDGVSSIACYDFRMDEWGVDVAVTGSQKGFMLPPGLAIVGFS PKAMAALDGAGLPRTFFDVRDMARGYAANGFPYTPPVGLLNGLKVATDMLLDEGLENVFARHHRIAEGV RQAVTAWGLTLCAARPALYSDSVSAIRTPDGFDANRIVSHALNTYGVAFGTGLGDVAGKVFRIGHLGMLT DVMALSGLATAEMVMVDLGLPVTLGSGVAAAQAHYRHSAGQACRQAA |
| 384 | MSFQNPVFIPGPTNMPEAIRKACDMPTIDHRSPLFGQILHPARAGVQEILKSETAEIFIFPSTGTGGWETAL TNTLCAGDTVLAARNGMFSHRWIDMCQRHGLDMTIVETPWGHGVPADRYAEILQADKEHKIKVVLATHN ETATGVKSDIAAVRKALDAANHPAMLFVDGVSSIGSMDFRFDEWGVDVAVTGSQKGFMLPAGLAIVGFS QKALAASKTAKLPRTFFDIADMTKGYAANAYPYTPAVGLMNGLLLATETLLKEGLENVFARHTRIASGVRA AVDAWGLDLCAASPDLYSDTVSAIKTPDGFNATDIVTHAAEKYGVAFGVGLGEVAGKVFRIGHLGSMTDV MALSGIATAEMCMVDLGLDIKLGSGVAAAQEYYRGTTGLKMRDAA |
| 385 | MSQQNPIFIPGPTNIPDRLRRAMNVPSQDHRAPDFSDTFLPVLSGVKKVIGTQDGEVLLFTSSGTGGWEA AISNTLSPGDKVLIARYGMFSHRWIDMCQRHGLDVQVVECPWGTGAPADQFEAILSADTEHEIKAVMVTH NETATGVMSDISAVRKAMDSATHPALLFVDGVSSIASVPFEMDAWGVDVAVAGSQKGFMLATGMAVLG VSQKALSHMDEAKLPRTYFDFRDMLRANSNGGFPYTPPLNLIYGLRESLEMLSEEGLENVYARHYRLAE GVRQAVSAWGFKLCAQSPDLYSNTVSAIFVPEGFNSNELTDHAFNKYGISFGIGLGEMNGKAFRIGHLGS LTEVMVLAGLATIEMAMVDLDYPIKLGQGVAAAQEYYRNN |
| 386 | MSFQNPVFIPGPTNMPEALRKAVDMPTLDHRSPLFGQILHPALAGVKKILKSETAEIFVFPSTGTGGWETA ITNTLNSGDKILAARNGMFSHRWIDMCQRHGLDVQVVETPWGEGLPADRYEEILTADTSHQIKAVLATHN ETATGVKSDIAAVRRALDAAGHPALLFVDGVSSIASMDFRMDEWGVDIAVTGSQKGFMLPPGLAIVGFSP KAMKAAETATLPRTFFDIKDMANGYANSAYPYTPSVGLLNGLNMACGMLLDEGLENVFARHHRIAEGVR AAVRAWGLELCAVSPDVYSDSVSAIRTPDGFDANKFVSLAAEKYGVAFGTGLGEVAGKVFRIGHLGSLTD VMALSGIATAEMVMADLGLNIQLGSGVAAAQDYYRGNTASSTKAAA |
| 387 | MSDQNPVFIPGPTNIPDRVRHAMNVQTRDHRSPDFVKTFAPVLEDCKRVFGTEAGQVITFPSTGTGGWE AAICNTLSAGDTVLIARYGMFSHRWIDMCQRHDLHVEVIECPWGSGAPADLFRERLNKDSAHKIKAVLVT HNETATGVLSDIGAVRKAMNTTSHPAMLFVDCVSSLGSMPFKMDAWGVDIAIAGSQKGFMLTTGMAILAA SPKALAAIETAQLPRTYFDFRDMMAANKNGGFPYTPPLQLIYGLKESLTMLFDEGLDNVYARHFRLAEGV RQAVAAWGFKLCANAPELYSHSVSAIYVPEGFDSNKLTDHAFNAYGVSFGIGLGEMNGKAFRIGHLGSLT EVMVLSGLAAIEMAMADLDYPITLGSGVAAAQEYFRKTAAANIG |
| 388 | MHMQNPVFIPGPTDMPEVLRKASDMPTIDHRSSLFGEILRPALAGVQKVVKSEAASIFVFPATGTGGWET AITNTLSPGDRVLAARNGMFSHRWIDMCQRHGLNVEIILASWGSGAPAERYEEILVADKAHEIKAVLVTHN ETATGVRSDVAAVRRAIDAARHPALLFVDGVSSIASMDFRMDEWGVDVAVTGSQKGFMLPAGLAITAFS PKALAALETAKLPRTFFDVRDMAKSYAGNAYPYTPAVGLLNGLKVSTEILLAEGLENVFARHTRIASGVRA AVGAWGLELCATSEDLYSDTVSAIRTPEGFDATSVVTHAAKKYDVAFGVGLGEVAGKVFRIGHLGSLTDV MALSGIATAEMVMADLGLGVRLGSGVAAAQEYYRNNQVSAVQGTA |
| 389 | MSGYNHLFIPGPTNIPEQVRQAMNLPMEDMRSPRFPELTLPLFADVKKVFKNRNGRVFIYPSSGTGAWE AAMTNVLSPGDKVLMSRFGQFSHLWVDMAERLGFEVDCLDREWGTGVPVELYAERLAADKAHKIKAVF VTHNETATGVTSDVAAVRAALDACGHPALLFVDGVSSIGSIDFRQDEWGVDCAVSGSQKGFMLPAGLGF LSVSQKALDAAKTARHMRCYFSFEDMIKTNDTGYFPYTPPTQLLRGLRAALDLIFEEGLENIFARHHHLAD GVRAAVSAWGLKLCATEPKWHSDTVSAIRLPEGVDGVEVIRHAYRTYNTSLGSGLSKVAGKVFRIGHLGS LNEVMVLGALSAAELTLLDCGVKIEPGVGVGAAIRQFRSAAATATAEAA |
| 390 | MSFQNPVFIPGPTNIPESLRKACDMPTIDHRSPLFGQILHPAREGVRKVLKSESAEVFIFPSTGTGGWETA LSNTLSAGDKVLAARHGMFSDRWIDMCRRHGLDVQVVETPWGEGLPADRFEEILTKDKGHEIKAVLATH NETATGVKSDIAAVRRALDQAGHPAMLFVDGVSSIASIDFRFDAWKVDVAVAGSQKGFMLPAGLAIVGFS EKAMDATRTSTLPRTFFDVNDMAKGYKNNGYPYTPAVGLLNGLNQACGMLLQEGLENVFARHHRIAQG VRAAVGAWGLELCAVDPSVYSDTVSAVRTPAGFNATDIVTHAAHKYGVAFGVGLGEVAGKVFRIGHLGS LTDVMALSGIATAEMCMADLGLKIELGSGVAAAQDYYRGHAAVARKDAA |
| 391 | MSEQNPVFIPGPTNIPNRLLNAMHIQTQDHRSPNFVETLTPVLEGCKKVFGTTTGEVITFPSTGTGGWEA AISNTLSAGDKVLIARYGMFSHRWIDLCQRHGLEVVVIECPWGDGAPADLFEAALNEDSNHDIKAVLVTH NETATGVRSDIAAVRKAMNNVNHPAMLFVDCVSSLASMPFEMDAWEVDIAISGSQKGFMLTTGMAILGV SQKALAAMETANLPRTFFDFRDMMGANANGGFPYTPPLQLIFGMKESLDMLFDEGLENVYARHFRLAEG VRQAVAAWGLKLCANTPELASDSVSAIYVPEGFDSNELTAHAFDKYGVSFGIGLGEMNGKAFRIGHLGSL TDVMVLSGLATIEMAMADLDYPIQLGAGVAAAQEYFRKTAKKANA |

FIG. 12AG

| | |
|---|---|
| 392 | MSFQNPVFIPGPTNMPEAVRQACYMPTIDHRSPTFGKILHPCLDGVRKVLKSDSAKIYIFPSTGTGGWET ALSNTLNKGDKVLAARNGMFSHRWIDMCQRHGLDVHVVETPWGEGLPADKYEEILKADKSHEIKVVLAT HNETATGVKSDIAAVRKALDAAGHPAMLFVDGVSSIASMDFRFDEWGVDVAVTGSQKGFMLPAGLAIVG FSDKAVQATKSATLPRTFFDINDMQKGYDNNAFPYTPPVGLMNGLKLSLDMLLDEGIENVFARHHRIAEG VRKAIGAWGLELCAASPDVYSDTVSAIRTPEGFNATDIVTVAANDYGMAFGVGLGEVAGKVFRIGHLGSL TDAMMLSGLGVAEMVMVDLGLDVKLGSGVAAAQEYYRRDLKNGSKAAA |
| 393 | MSFQNPVFIPGPTNIPESLRKACDMPTIDHRSPLFGQILHPARDGVRKVLKSEVAEIFIFPSSGTGGWETAL TNTLSEGEKILAARNGMFSHRWIDMCQRHRLDVQIVETPWGEGLPADRYEEILAADKSHQIKAVLATHNE TATGVKSDIAAVRKALDAAGHPALLFVDGVSSIASMDFRFDEWGVDVAVTGSQKGFMLTAGLAIVGFSPK AMDATKTGTLPRTFFDVHDMAKGYANNAYPYTPAVGLMNGLNESCKMLLSEGLENVFARHTRIAQGVRA AVTAWELELCAVSPDVYSDTVSAIKTPDGFNATDIVTHAAETYGVAFGVGLGEVAGKVFRIGHLGSLTDV MTLSGIATAEMCMADLGLDVPLGSGVAAAQEYYRSNPAATALKAA |
| 394 | MSFQNPVFIPGPTNIPEVIRKACDMPTIDHRSSVFGEIFAPVRENLKKVLKTTSGEIIIFPASGTGAWEASIS NTLSPGDKVLAARNGMFSHRWIDMCQRHGLEVQIVETPWGEGIPANKYQEILAADKGHEIKAVLATHNET ATGVRSDIGAVRAAMDAAKHPALLMVDGVSSVASMDFRMDDWGVDLAVTGSQKGFMMPAGLAICGVS QKALSHMDAAKLPRTFFDFRDMLNAYAAGGYPYTPAVGLLNGLNTSVNMLLDEGLEAVFDRHHRIAEGV RRAIAAWGLKPCAANPSLYSDTVTAVVVPEGFNGSAVATHAAEAYGMAFGVGLGEVATKVFRIGHLGSL TEAMMLSGLSVAEMSMVDLGIPVKLGSGVAAAQEYYRVGSAAMQAAAE |
| 395 | MFAQNPVFIPGPTNMPEVLRRAADMPTLDHRSPLFAQILHPALAGVKGVLKSQDAEVFVFPSTATGGWE TALSNTLSAGDAVLAARHGMFSHRWIDMTRRHGLDVRVIEAPWGEGLPADRFAEALAADTAHRIRAVLVT HNETATGVRSDVAAVRRALDASGHPALLLVDGVSSIASMDFRMDEWGVDVAVTGSQKGFMLPAGLAIVA FSPRAMAATATATLPRTYFDVRDMAKGYPNGAYPYTPAVGLLNGLKLSTELLLAEGLDNVFARHRRIADG IRAAVAAWGLELCAARPDLYSDTVSAICAPEGFDATRIVTHAARHYDVAFGVGLGEVAGKVFRIGHLGSLT DVMALSGIAAAEMAMADLGLRIELGSGVAAAQAVYRRAPAAGLRAAA |
| 396 | MSFQNPVFIPGPTNIPEALRKACDMPTIDHRSPLFGQILHPARRGVRQVLKSDTAKVFIFPSTGTGGWETA LTNCLSAGDKVLAARNGMFSHRWIDMCQRHGLDVQIVETPWGDGLPADRYEEILTADTSHQIKVVLATH NETATGVKSDIAAVRKALDAAGHPALLFVDGVSSIGSMDFRFDDWSVDVAVAGSQKGFMLPAGLAIVGFS AKAMEATKTAALPRTFFDVHDMAKGYDNNAYPYTPAVGLLNGLNEACTMLLAEGLENVFARHTRIATGV RAAVDAWGLNLCAASPDVYSDTVSAICTPDGFNATDIVTHAAETYGVAFGVGLGEVAGKVFRIGHLGSLT DVMTLSGIATAEMCMVDLGLDIKLGSGVAAAQEFYRLNPAARLQNAA |
| 397 | MSFQNPVFIPGPTNMPEVLRKAVDMPTLDHRSPLFGQILHPAIAGVKQVLKSKSAEVFIFPASGTGGWET ALTNTLSAGDKILAARNGMFSHRWIDMCQRHDLDVTIVETPWGEGLPADRYEEILTADTNHEIQAVLATHN ETATGVKSDIAAVRRALDAAGHPALLFVDGVSSIASMDFRMEEWGVDVAVTGSQKGFMLPAGLAIVGFS PKAMEVIETAKLPRTFFDVRDMAAGYANNAYPYTPAVGLLNGLKLSCDMLLGEGLENVFARHNRIASGVR AAVGAWGLDLCAASPDVYSDSVSAIRTPEGFNATDIVTLAAEKYGVAFGVGLGEVAGKVFRIGHLGSLTD VMALSGIATAEMCMVDLGLDITLGSGVAAAQDYYRNQDAAPAKAAA |
| 398 | MSFQNPVFIPGPTNMPERIRTACDMPTIDHRSPTFGRILHPCLENVRKILKSDNAHIFIFPSTGTGGWETAL TNTLSPGDKVLAARNGMFSHRWIDMCQRHQLDVDIVETPWGAGLPAERYAEILAADTAHEIKVVLATHNE TATGVKSDIAAVRRALDDAGHPALLFVDGVSSIASMDFRFDEWGVDIAVTGSQKGFMLPAGLAIVGFSDK AKAASETATLPRTFFDIKDMAGGYAANAFPYTPPVGLMRGLKLATDLLLEEGLENVFARHHRIAEGVRRA VDAWGLELCAQSADVQSDTVSAIKTPEGFDATDIVTRAAETYGVAFGVGLGEVAGKVFRIGHLGSLTDVM ALSGLATAEMCMVDLGLDIKLGSGVAAAQEYYRTNPAQSALPVD |
| 399 | MVVSTQNPIFIPGPTNIPEVLRKAVDMPTIDHRSPLFGKILHPAIEGVKKVLKTKQAKLFVFPSTGTGGWET AITNVLSPGDKVLATRNGMFSHRWIDMCQRHGLDVIVVPQDWGESVPADRFEEILAADKAHKIKAVLATH NETATGVRSDIAAVRHAMDAAAHPALLLVDGVSSIASMDFRMDEWGVDIAVTGSQKGFMLPPGLAILGFS PKALEAVEAAKLPRTFFDIRDMARSYANNGYPYTPPVGLLNGLKIASEMLLEEGMENVFARHHRIAEGIRQ AVAAWGLRLCAVRPELYSDTVSAIRVPDGFDGNRVVAHALNVYGVAFGTGLGDVAGKVFRIGHLGSLTD VMALSGIATAEMVLVDLGLPIKLGSGVAAAQEHYRLSAGNAQKRAA |
| 400 | MSDQNPVFIPGPTNIPDRLRRAMQVTQDHRSPAFVNTLAPVLKGCKTVFGTAKGEIITFPASGTGGWEA AITNTLSPGDKVLVARYGMFSHRWIDMCQRHGLDVQIIECPWGSGAPADRFQEALSADKDHSIKAVLVTH NETATGVRSDIAAVRGAMKASNHPALLMVDCVSSLGSMPFEMDTWGVDIAVSGSQKGFMLNTGMAILAV SPKALAMMETAKLPRTFFDFRDMMGANAKGGFPYTPPLQLIYGMAESLNMLFEEGLDNVYARHTRIAEG VRRAVAAWGLKLVAQTPDLYSDTVSAVFVPEGFDSNRLTERVFGTYGMSFGVGLGEMNGRAFRIGHLG SLTESMMLSGLATLEMAMADLNYPVKMGSGVIAAQEYYRATAKPVLAEKAA |
| 401 | MFAQNPVFIPGPTNMPEVLRRAADMPTLDHRSPLFAQILHPALAGVKTVLKSQDAEVFVFPSTATGGWET ALSNTLSAGDAVLAARHGMFSHRWIDMTRRHGLDVRVIEAPWGEGLPADRFAEALAADTAHRIRAVLVT HNETATGVRSDVAAVRRALDASGHPALLLVDGVSSIASMDFRMDEWGVDVAVTGSQKGFMLPAGLAIVA FSPRAMAATATATLPRTYFDVRDMAKGYPNGAYPYTPAVGLLNGLKLSTELLLAEGLDNVFARHRRIADG IRAAVAAWGLELCAARPDLYSDTVSAICAPEGFDATRIVTHAARHYDVAFGVGLGEVAGKVFRIGHLGSLT DVMALSGIAAAEMAMADLGLRIELGSGVAAAQAVYRRAPAAGLRAAA |

FIG. 12AH

| | |
|---|---|
| 402 | MSGYNHLFIPGPTNIPEQIRQAMNLPMEDMRSPRYPELTLPLFADVKKVFKNRNGRVFIYPSSGTGAWEA<br>AMTNVLSPGDRVLMSRFGQFSHLWVDMAERLGLEVDCLDREWGTGVPVDLYTERLAADKAHRIKAVFV<br>THNETATGVTSDVAAVRAALDASGHPALLFVDGVSSIGSIDFRQDEWGVDCAVSGSQKGFMLPAGLGFL<br>SVSQKALEAAKTARHMRCYFSFEDMIKTNDTGYFPYTPPTQLLHGLRAALDVIFEEGLENIFARHRHLADG<br>VRAAVSAWGLKLCATEPKWYSDTVSAIRLPEGIDGVKVIRHAFDTYNTSLGSGLSKVAGKVFRIGHLGSLN<br>EVMVLGALSAAELTLLDCGVKIEPGAGVGAAIRQFRAAATATAKAA |
| 403 | MHQQNPVFIPGPTNMPEVLRKASDMPTIDHRSPMFGEILRPGLAGVKKVLKSEAASIFVFPATGTGGWET<br>AITNTLSPGDRVLAARNGMFSHRWIDMCQRHGLNVEIILASWGSGAPADRYEEILAADKAHEIKAVLVTHN<br>ETATGVRSDIAAVRRAIDAARHPAMLFVDGVSSIASMDFRMDEWGVDIAVTGSQKGFMLPAGLAITAFSP<br>KALAALETAKLPRTFFDVRDMSKSYENNAYPYTPAVGLLNGLKVSTEILLAEGLENVFARHKRIASGVRAA<br>VRAWGLELCATSEDLYSDTVSAIRTPEGFDATSVVTHAAKKYDVAFGVGLGEVAGKVFRIGHLGSLTDVM<br>ALLGIATAEMVMADLGLAIKLGSGVAAAQEFYRSSHVPAGQGAA |
| 404 | MSFQNPVFIPGPTNIPESLRKACDMPTIDHRSPLFGQILHPAREGVRKVLKSDAAEVFIFPSTGTGGWETA<br>LSNTLSPGETVLAARNGMFSHRWIDMCQRHGLSVEIVETPWGEGLPAHRYAEILAADTQHRIKAVLATHN<br>ETATGVRSDIAAVRRALDDAGHPALLFVDGVSSIASMDFRFDEWGVDCAVAGSQKGFMLPPGLAIVGFS<br>DKAMAATQTARLPRTFFDVQDMAKGYANNAYPYTPAVGLLNGLNEACRMLLDEGLENVFARHHRIAEGV<br>RCAVRAWGLELCAASPEVYSDTVSAIRTPDGFNATDIVSHAAQTYGVAFGTGLGEVAGKVFRIGHLGSLT<br>DVMTLSGLATAEMCMKDLGLDITLGSGVAAAQEFYRATPALARKAAA |
| 405 | MSFQNPVFIPGPTNMPEALRKAVDMPTLDHRSPLFGQILHPALAGVKKVLKSETAEIFVFPSTGTGGWET<br>AITNTLNAGDKILAARNGMFSHRWIDMCQRHGLDVQVVETPWGEGLPADRYEEILTADTSHQIKVVLATH<br>NETATGVKSDIAAVRRALDAAGHPALLFVDGVSSIASMDFRMDEWGVDIAVTGSQKGFMLPPGLAIVGFS<br>PKAMKAAETATLPRTFFDIKDMANGYANSAYPYTPSVGLLNGLNMACGMLLDEGLERVFARHHRIAEGV<br>RAAVRAWGLELCAVSPDVYSDSVSAIRTPDGFDANKFVSLAAEKYGVAFGTGLGEVAGKVFRIGHLGSLT<br>DVMALSGIATAEMVMADLGLDIPLGSGVAAAQDYYRGNTASSAKAAA |
| 406 | MSGYNHLFIPGPTNIPEQVRQAMNLPMEDMRSPRYPELTLPLFADVKKVFKNHSGRVFIYPSSGTGAWE<br>AAMTNVLSPGDRVLMSRFGQFSHLWVDMAERLRFEVDCIDREWGTGVPVELYAERLAADKAHKIKAVFV<br>THNETATGVTSDVAAVRASLDACGHPALLFVDGVSSIGSIDFRQDEWGVDCAVSGSQKGFMLPAGLGFL<br>SVSAKALEAARTARHMRCYFSFDDMIKTNDAGYFPYTPPTQLLRGLRASLDLIFEEGLENIFARHHYLANG<br>VRAAVSAWDLQLCATEPKWHSDTVSAIRLPEGVDGVEVIRHAYRTYNTSLGSGLSKVAGKIFRIGHLGSL<br>NEVMVLGALSAAELTLLDCGVKIEPGSGSGAAIKQFRSAATASTAKAA |
| 407 | MYLQNPVFIPGPTNMPEVLRKASDMPTIDHRSPLFGEILRPALAGVKKVVRSQSASIFVFPATGTGGWET<br>AITNTLSPGDRVLVARYGMFSHRWIDMCQRHGLDVSVIETPWGSGAPVDRYEEMLTADKAHQIKAVLVT<br>HNETATGVKSDIAALRRALDAARHPAMLFVDGVSSIASMEFRMDDWGVDVAVTGSQKGFMLPAGLAITA<br>FSPKALAAIETAKLPRTFFDVRDMSKSYENNAYPYTPVVGLLNGLKVSTEMLLAEGLENVFARHNRIATGI<br>RAAVRAWGLELCAMSEDLYSDTVSAIRTPDGFDATSVVTHAAKKYDVAFGVGLGEVAGKVFRIGHLGSLT<br>DVMALSGIATAEMVMADLGLAIKLGSGVAAAQDYYRNNQVSAGNGAA |
| 408 | MTSQNPIFIPGPTNIPEEMRKAVDMPTIDHRSPVFGRMLHPALEGVKKVLKTTQAQVFLFPSTGTGGWET<br>AITNTLSPGDKVLAARNGMFSHRWIDMCQRHGLDVTFVETPWGEGIPADRFEEILTADKGHEIRVVLATH<br>NETATGVKSDIAAVRRALDAAKHPALLFVDGVSSIGSMDFRMDEWGVDIAVTGSQKGFMLPPGLAIVGFS<br>PKAMAAVESARLPRTFFDIRDMATGYARNGYPYTPPVGLINGLNASCERILAEGLENVFARHHRIASGVR<br>AAVEAWGLKLCAVRPELYSDSVSAIRVPEGFDANLIVSHALETYDMAFGTGLGQVAGKVFRIGHLGSLTD<br>AMALSGIATAEMVMADLGLPIKLGSGVAAAQEHYRQTTAAAQKKAA |
| 409 | MTSQNPIFIPGPTNIPEEMRKAVDMPTIDHRSPVFGRMLHPALEGVKKVLKTETALVFLFPSTGTGGWETA<br>ITNTLSPGDKVLAARNGMFSHRWIDMCQRHGLDVTYVETPWGEGIPADRFEEILTADKGHEIRVVLATHN<br>ETATGVKSDIAAVRRALDAAKHPALLFVDGVSSIGSMDFRMDEWGVDIAVTGSQKGFMLPPGLAIVGFSP<br>KAMEAVESARLPRTFFDIRDMATGYARNGYPYTPPVGLINGLNLSCERLLAEGLENVFARHRRIAGGVRA<br>AVEAWGLKLCAVRPELYSDSVSAIRVPEGFDANLIVSHALETYDMAFGTGLGQVAGKVFRIGHLGSLTDA<br>MALSGIATAEMVMADLGLPIRLGSGVAAAQEHYRQTTAAAQKKAA |
| 410 | MTSQNPIFIPGPTNIPEEMRKAVDMPTIDHRSPVFGRMLHPALEGVKKVLKTESAQVFLFPSTGTGGWET<br>AISNTLSPGDKVLAARNGMFSHRWIDMCQRHSLDVTYVETPWGEGIPADRFEEILTADKGHEIRVVLATH<br>NETATGVKSDIAAVRRALDAAKHPALLFVDGVSSIGSMDFRMDEWGVDIAVTGSQKGFMLPPGLAIVGFS<br>PKAMEAVETARLPRTFFDIRDMATGYARNGYPYTPPVGLINGLNVACERLLSEGLENVFARHNRIASGVR<br>AAVEAWGLKLCAVRPELYSDSVSAIRVPEGFDANRIVSHALETYDMAFGTGLGEVAGKVFRIGHLGSLTD<br>AMALSGIATAEMVMADLGLPVKLGSGVAAAQEHYRQSTAAALKKAA |
| 411 | MSDQNPVFIPGPTNIPDRLRRAMQVTQDHRSPAFVNTLAPVLKGCKTVFGTAKGEIITFPASGTGGWEA<br>AITNTLSPGDKVLVARYGMFSHRWIDMCERHGLDVQIIECPWGSGAPADRFQEALTADKGHSIKAVLVTH<br>NETATGVVSNIAAVRAAMKAAKHPALLMVDCVSSLGSMPFEMDTWGVDIAVSGSQKGFMLNTGMAILAV<br>SPKALAMMETAKLPRTFFDFRDMMGANAKGGFPYTPPLQLIYGMAESLNMLFEEGLDNVYARHTRIAEG<br>VRLAVAAWGLKLVAQTPDLYSDTVSAVFVPEGFDSNRLTERVFSTYGMSFGVGLGEMNGRAFRIGHLGS<br>LTESMMLSGLATLEMAMADLNYPVKMGSGVIAAQEYYRSTAKPVLAEKAA |

FIG. 12AI

| | |
|---|---|
| 41 | MSDQNPIFIPGPTNIPDRLRFAMNVQSSDHRSPGFVETLSPLLQDCKKVFNTQSGEVILFPASGTGGWEA AICNTLSPGDKVLIARYGMFSRRWIEMCQRHGLDVQIIECPWGSGAPANEFKRALSADTQHKIKAVLVVH NETATGVTSDIDAVRQAMDSCSHPALLLVDCVSSLASMPFEMDNWGVDIAVSGSQKGFMLITGMAILAVS QKALAAMETAKLSCAFFDFRAMMTANAQGGFPYTPPLQLIYGLKESLKMLFEEGLDNVYARHFRLAEGV RQAAHAWGMALCAQSPDLYSNTVTAIYVPEGFDSNELTDHTFAKYGVSFGIGLGEMHGKAFRIGHLGSL TDSMVLSGLATIEMAMADLDYPIELGSGVRAAQNHFRATTA |
| 42 | |
| 43 | MYLQNPVFIPGPTNMPEVLRKASDMPTIDHRSPLFGEILRPALAGVKKVVKSQSASIFVFPATGTGGWET AITNTLSPGDRVLVARYGMFSHRWIDMCQRHGLDVSVIETPWGSGAPVDRYEEMLTADKAHQIKAVLVT HNETATGVKSDIAAVRSALDAARHPAMLFVDGVSSIASMEFRMDDWGVDVAVTGSQKGFMLPAGLAITA FSPKALAALETAKLPRTFFDVRDMSKSYENNAYPYTPAVGLLNGLKVSTEMLLAEGLENVFARHNRIATGI RAAVRAWGLELCAMSEDLYSDTVSAIRTPDGFDATSVVTHAAKKYDVAFGVGLGEVAGKVFRIGHLGSLT DVMALSGIATAEMVMADLGLSIKLGSGVAAAQDYYRNNQVSAGRGERL |
| 44 | MYTQNPVFIPGPTNMPEVLRRAADLPTIDHRSAAFADILQPALAGVRKVVVKSENAEIVVFPATGSGGWEA AITNLLSPGDKVLAARHGMFSHRWIDMCQRHGLQVDAVHSSWKQPLPLAEYEKRLFADKGHDIKAVLVT HNETATGVKSDVGAVRRLLDEARHPALLLVDGVSSIASMDFRMDEWKVDAAITGSQKGFMLPVGLAILAL SPKAMQAAQSAKLHRAFFDIREMAKTYPSSGYPYTPSIGLLNGLKVSTELLLGEGLDNVFKRHARIASGV RAAVSAWGLRLYAQEASSYSDTVSAVETPEGFDATSIVTHAAQKYAVAFGAGLGDVAGRVFRIGHLGSM SDVMALSGIAAAEMAMADLGLPIRLGSGVAAAQEIYRNTAATPARNAA |
| 45 | MSFQNPVFIPGPTNIPENLRKACDMPTIDHRSPLFGQILHPARAGVRKVLKSTSAEVFIFPSTGTGGWETA LTNTLSAGDTVLAARNGMFSQRWIDMCQRHGLNVNVVETPWGQGVPADRYAEILAADTGHQIKAVLATH NETATGVRSNIAAVRHALDTAGHPAMLFVDGVSSIGSMEFRFDDWGVDVAVTGSQKGFMLPAGLGIVGF SAKAMEATKSAKLPRTFFDVHDMAKGYANNAYPYTPAVGLLNGLNTACGMLLSEGLDAVFARHHHRIAEG VRAAVGAWGLELCAASPDLYSDTVSAIRTPEGFNATDIVTHAAEAYGVAFGVGLGEVAGKVFRIGHLGSL TDVMMLSGIATAEMCMADLGLDITLGSGVAAAQDYYRANRTVRQQDAA |
| 46 | MSFQNPVFIPGPTNMPEAIRKACDMPTIDHRSPLFGGILHPCLDGVRKVLKSDAAHVFIFPATGTGGWET ALTNTLSPGDRVLAARNGMFSHRWIDMCQRHKLDVDVVETPWGHGVPADRYEEILTADTGHGIKAVLAT HNETATGVKSDIAAVRRALDAAGHPALLLVDGVSSIGSMDFRFDDWGVDVAVTGSQKGFMLPAGLAIAG FSDKAMEATATAALPRTFFDVKDMQKGYDSDAFPYTPPVGLMNGLRLSLDMLLDEGLENVFARHHRIAE GVRRAVGAWGLELCAASPELYSDSVSAIRTPEGFNATDIVTLAARDYGMAFGVGLGEVAGKVFRIGHLG MLTDAMMLSGLGVAEMAMVDLGLDITLGSGVAAAQEHYRHGNTARKAAA |
| 47 | MTDQNPVFIPGPTNIPDRLRNAMHLQTRDHRAPDFVETFAPVLRDCKRVFGTETGEVITFPSSGTGGWE ASICNTLSAGDKVLIARYGMFSHRWIDLCQRHNLDVQVIECAWGSGAPADKFAEVLSADNGHEIKAVLVT HNETATGVKSDIAAVRQAMDASGHPALLFVDCVSSLASMPFEMDAWGVDIAVSGSQKGFMLNTGMAILG VSQKALAAMETATLTRTFFDFRDMMAANANGGFPYTPPLQLIYGMKESLAMLFEEGLENVYARHHRLAE GVRKAVDAWGLKLCAQSPELYSDTVSAIYVPEGFDSNQLTEHAFNAYGVSFGIGLGEMNGKAFRIGHLG SLTDVMVLSGLATIEMAMADLNYPITLGSGVAAAQEYFRKTASKNCA |
| 48 | MSLQNPVFIPGPTNMPESLRKACDMPTIDHRSPAFAAVFQPAVAGVKEVLGMEAGEVLLLPATGTGGWE AAISNALSPGDKVLAARHGMFSHRWIDLCQRHGLDVQIIEAPWGEGCPTDAMGEALAADTDHSIKAVLAT HNETATGVRSDIAGLRAAMDKAGHPALLLVDGVSSIASMPFEMDAWGVDIAVAGSQKGFMLPAGLAILGV SSKALAARDSATLPRTYFDFGDMLKGYAAGGYPFTPPVGLINGLAASIAMLQAEGLDNVYARHHRLAEAT RRAVGGWGLKVCAARPDLYSDTVTGVMAPEGFNGTDVVTLAASKYGVAFGVGLGEVAGKLFRIGHLGS LTDVMLLSGLATAEMCMADLGWPVKLGSGVAAAQEYLRGTTAESIAKAA |
| 49 | MFAQNPVFIPGPTNMPEVLRRAADMPTLDHRSPLFAQILHPALAGVKKVLKSEDAEVFIFPSTATGGWET ALSNTLSAGDTVLAARHGMFSHRWIDMTRRHGLDVRMIEAPWGEGLPADRFAEALAADKAHRIRAVLVT HNETATGVRSDVAAVRRALDASNHPALLLVDGVSSIASMDFRMDEWGVDVAVTGSQKGFMLPAGLAIVA FSPKAMAATATATLPRTYFDIRDMAKGYPNGAYPYTPAVGLLNGLKLSTELLLAEGLETVFARHRRIADGI RAAVAAWGLELCAARPDLYSDTVSAIRTPEGFDATRIVTHAARHYDVAFGVGLGEVAGKVFRIGHLGSLT DVMALSGIAAAEMAMADLGLRIALGSGVAAAQAVYRRAPAAALRAAA |
| 420 | MENQNPVFIPGPTNIPERLRKAMSVPTWDHRSPEFGRMFVPLLQDLKQPFGTTRGDVAVFTASGTGGW ETAITNTLSPGDTVLAARYGMFSHRWIDLCERHGLDVKVIDCGWGEGAPIAAYRDALAADTDHRIKAVLSV HNETATGVRSDVGAVREAMDAADHPAMLFVDGVSSIGSMEFRMDDWGVDMAVAGSQKGFMLATGLAI VAASPKAQAAMETAQLPRCYFDLRDMLAAGGKGSYPYTPAIGLIEGLRESVNMLLAEGLDNVHARHFRIA EGVRRAVAAWGMEVCARHPELNSDTVTAIMVPDGFDSTELVNYANETYGVSFGIGLGQVAGQLFRIGHL GQMSDVMALSGIATAEMAMKDLGYPIELGSGVAAAQEYYRANSAVAQRKTA |
| 421 | MSDQNPVFIPGPTNMPDRLRRAMQVQTQDHRSPAFVETLTPVLEGCKTVFRTTTGTIITFPASGTGGWE AAISNTLSPGDTVLVARYGMFSHRWIDMCQRHGLNVQIIECPWGSGAPADKFQEALSADADHAIKAVLVT HNETATGVKSDIAAVRRAMNTANHPAMMFVDCVSSLGSMEFRMDDWGVDIAVSGSQKGFMLATGMAIL AVSPKAIAAMDTAKLPRTFFDFRDMMSANAGGGYPYTPPLQLIYGMAESLKMLFEEGLENVYARHHRLAT GVRRAVDAWGLRLVAQSPELYSDTVSAVFVPEGFDSNALIEHVFATYGVSFGIGMGEMNGRAFRIGHLG SLTDTMVLSGLATIEMAMADLGYPVKLGSGVVAAQEYFRATTKPALAKAA |

FIG. 12AJ

| | |
|---|---|
| 422 | MSFQNPVFIPGPTNMPEAVRQACYMPTIDHRSPTFGKILHPCLEGVQQVLKSDTAKVFIFPSTGTGGWET<br>ALSNTLSKGDKVLAARNGMFSHRWIDMCQRHGLDVQIVETAWGEGLPADRYEEILRADKSHDIKVVLATH<br>NETATGVKSDIAAVRRALDAAGHPALLFVDGVSSIASMDFRFDEWGVDVAVTGSQKGFMLPAGLAILGFS<br>DKSIAASKNAGLPRTFFDIKDMQNGYNANAFPYTPPVGLMNGLKLSLEMLLGEGLENVFARHHRIAEGVR<br>AAVSAWGLDLCAVSPDVYSDTVSAIRTPEGFNATDIVTLAAEKYDVAFGVGLGEVAGKVFRIGHLGSLTD<br>VMTLSGLATAEMCMADLGLDITLGSGVAAAQQYYRSNSALTQRIAA |
| 423 | MSFQNPVFIPGPTNMPEALRKAVDMPTLDHRSPLFGQILHPALAGVKKILKSETAEIFVFPSTGTGGWETA<br>ITNTLNSGDKILAARNGMFSHRWIDMCQRHGLDVQVVETPWGEGLPADRYEEILTADTSHQIKAVLATHN<br>ETATGVKSDIAAVRRALDAAGHPALLFVDGVSSIASMDFRMDEWGVDIAVTGSQKGFMLPPGLAIVGFSP<br>KAMKAAETATLPRTFFDIKDMANGYANSAYPYTPSVGLLNGLNMACGMLLDEGLENVFARHHRIAEGVR<br>AAVRAWGLELCAVSPDVYSDSVSAIRTPDGFDANKFVSLAAEKYGVAFGTGLGEVAGKVFRIGHLGSLTD<br>VMALSGIATAEMVMADLGLNIQLGSGVAAAQDYYRGNTASSTKAAA |
| 424 | MTSQNPVFIPGPTNIPEILRKAVDMPTIDHRSPVFGKILHPALEGVKKVLKTAEGQVFVFPSTGTGGWETAI<br>SNTLSPGDKVLATRNGMFSHRWIDMCQRHGLDVEVVDQKWGEGVPADRFEEILTADKAHQIKAVLATHN<br>ETATGVKSDIAAVRRAMDAAGHPALLFVDGVSSIGSMDFRMDEWGVDIAVTGSQKGFMLPPGLAIIGFSP<br>KAMAALETAKLPRTFFDIRDMAKGYAANGFPYTPPVGLINGLNLSTQMLLEEGLENVFARHHHRIAEGVRK<br>AVAAWGMELCAARPELYSDSVSAIRVPEGFDANKVVGHALEAYGVAFGTGLGDVAGKVFRIGHLGSLTD<br>VMALSGIATAEMVMADLGLPVALGSGVAAAQEHYRQSAAALEKAA |
| 425 | MHASNPIFLPGPTNLPEPLRRACDIPTMDHRSAAFGPILAAAKDGVARILGLSGGEVALFPATGTGGWEA<br>AVTNALRPGDKVLAARHGMFSRKWIDLCQRHGLEVEIVERPWGEGVPVEEFAAALAADGGHQIRAVLVT<br>HNETATGVTSDVAAVRAAMDATGHPALLMVDGVSSIGSIEFRMDDWGVDLAVAGSQKGFMLPAGLAIIGI<br>SAKARQAMETAGLPRCFFDIRDMADGNYPYTPPVGLINGLAVSTGLLLEEGMENVRARHHRIAEGVRRA<br>VAAWDMTTCAAAPELCSDTVTAIVTPEGFDAGRIVRHAAEAYGVAFGGGLGEVAGKVFRIGHLGLMSDV<br>MALSGIATAEMAMVDLGLPVRLGSGVAAAQEHYRNSRTAPVQAAA |
| 426 | MSFQNPVFIPGPTNMPEAVRQACYMPTIDHRSPTFGKILHPCLEGVRKVLKSKDAKIFIFPSTGTGGWETA<br>LSNTLSKGDKVLAARNGMFSHRWIDMCQRHGLDVHVVETPWGEGIPADKYEEILKADTKHEIKVVLATHN<br>ETATGVKSDIAAVRKALDAAGHPAMLFVDGVSSIASMDFRFDEWGVDVAITGSQKGFMLPAGLAIIGFSG<br>KAIAAAEKSDLPTTFFDIKDMQKGYDANAFPYTPPVGLMNGLKLSLDMLLEEGLENVFARHHRIAEGVRKA<br>VSAWGLELCAASPDLYSDTVSAIRTPEGFNATDIVTHAADKYDVAFGVGLGEVAGKVFRIGHLGSLTDVM<br>TLSGLATAEMCMVDLGLDVKLGSGVAAAQEYYRTNPVAGK |
| 427 | MSDQNPVFIPGPTNMPDRLRRAMQVQTQDHRSPAFVETLTPVLEGCKTVFGTANGTIITFPASGTGGWE<br>AAISNTLSPGDKVLVARYGMFSHRWIDMCQRHGLDVQIIECPWGSGAPADKFQEALSADTDHTIKAVLVT<br>HNETATGVKSDIAAVRRAMNTANHPAMMFVDCVSSLGSMDFRMDGWGVDIAVSGSQKGFMLATGMAIL<br>AVSPKAIAAMETAKLPRTFFDFRDMMGANAAGGYPYTPPLQLIYGMAESLKMLFEEGLDNVYARHHRLAT<br>GVRRAVDAWGLKLVAQSPDLYSDTVSAVFVPEGFDSNALIEHVFATYGVSFGIGMGEMNGRAFRIGHLG<br>SLTDTMVLSGLATIEMAMADLDYPIKLGSGVVAAQEYYRATTKPALAKAA |
| 428 | MKTGCTHLFIPGPTNIPEPVRQAMNVPMQDMRAPDFGDLTLGLFSDLKRVLRTESGRVFLFPGSGTGAW<br>EEAAITNTLNPGDKVLMSRFGQFSHLWVEMAERLGLDVEVIDVPWGGGCPVKEYARRLGADKHGEIKAVF<br>VTHNETATGVTSDVAGVRRALDESFHDALLFVDGVSSIASIDFRMDDWGVDLAVTGSQKGLMLPAGLGV<br>LGVSEKAMEASKTATMRRAYFEFSDMVKLNETGYFPYTPPTQLFHGLRRSLDRIFDEGLDNVIARHHRLA<br>EGVRRGVHAWGMELVAEHPSLWSDTVSAIRVPAEVDARDVIRIGYERYNISFGTGLAQLAGKVFRIGHLG<br>DLNEGMCLTALSLAELSLAAAGARVEFGSGVAAAQDWYAKNSAAPDLKIAAE |
| 429 | MSSQNPVFIPGPTNIPESIRRACDIPTMDHRSAAFPPLFERAKSGVRQMLKMDEGEVILFPASGTGGWEA<br>AVTNTLSPGDKVLAAQHGMFSLKWIDLCERHGLDVEVVKCPWGEGAPVERFAEILAADTSHEIKAVLVTH<br>NETATGVTSDVAAVRAAMDDAGHPALLMVDGVSSIASIDFRMTEWGVDLAVTGSQKGFMLPVGLAIVGV<br>SPKALTAMETAKLSRCFFDFRDMLKLGTPYTPAVGLINGLGAACDMLLEEGLKNVFARHHRIAEGVRAAV<br>SAWGMRPCADRPALYSDTVTAIVLPEGVDGNALVRHAAEAYHVAFGAGLGEVAGKVFRIGHLGQLTDVM<br>ALSGIATAEMAMADMGVAVTLGSGVAAAQDYYRTNKAAPVKAAA |
| 430 | MSFQNPVFIPGPTNIPESLRKACDMPTIDHRSPLFGQILHPARDGVRKVLKSETAEVFIFPSSGTGGWETA<br>LSNTLSAGDTVLAARNGMFSHRWIDMCQRHGLEVQIVETPWGAGLPADRYEEILNADKAHKIKAVLATHN<br>ETATGVKSDIAAVRRALDAAGHPALLFVDGVSSIASMDFRMDEWGVDVAVTGSQKGFMLSAGLAIVGFS<br>PKAMEATKTAQLPRTFFDVHDMAKGYANNAYPYTPAVGLMNGLNESCKMLLAEGLENVFARHHRIAEGV<br>RAAVGAWGLELCAASPEVYSDTVSAIRTPEGFNATDIVTHAADKYGVAFGVGLGEVAGKVFRIGHLGSLT<br>DVMALSGIATAEMCMVDLGLDIQLGSGVAAAQDYYRGNAASAQQDAA |
| 431 | MNFQNPVFIPGPTNMPEAIRQACYMPTIDHRSPVFGKILNPCLEGVRKVLKSDSARIFIFPSTGTGGWETA<br>LTNTLSPGDGILAARNGMFSHRWIDMCQRHGLDVTVVETPWGEGLPAENYEEVLKADKDHRIKAVLATH<br>NETATGVKSDIAAVRRALDAARHPALLFVDGVSSIGSMDFRFDDWGVDVAVTGSQKGFMLPAGLAIVGF<br>SDKAMKATETAKLPRTFFDVRDMGKGYDNNAFPYTPPVGLMNGLKLSLDMLLDEGLENVFARHHRIAEG<br>VRRAVRAWGLELCAVSPDLYSDTVSAIRTPEGFNATDIVTVAARDYDMAFGVGLGEVAGKVFRIGHLGSL<br>TDAMMLSGLGVAEMVMVDLGLDVKLGSGVSAAQEFYRHGGTARKAAA |

FIG. 12AK

| | |
|---|---|
| 432 | MSNQNPVFIPGPTNIPDRLRLAMQVQTQDHRAPDFVETFAPVLEDTKKVFGTTTGQIVTFPSSGTGGWE<br>AAITNTLSPGDKVLVARYGVFSHRWVDLCERHGLDVQIVECPWGTGAPADQFQAALANDTAHEIRAVLVT<br>HNETATGVRSDIAAVRQAMDSENHPSMLFVDCVSSLASMPFDFDAWGVDIAVSGSQKGFMLATGMAILC<br>VSPKAQDAMKSAKLPRTFFDFDDMMAANASGGFPYTPPLQLIYGMRESLKMLFEEGLENVYARHFRLAE<br>GVRRAVDAWGLKLVAQSPDLYSDTVSAIYVPNGYDSNTLTDHAFNAYGVSFGIGLGQLNGKTFRIGHLGS<br>LTDVMVLSGLGTIEMAMADLNYPITLGSGVAAAQDFYRTGPSDRAQAAA |
| 433 | MYGQNPVFIPGPTNMPEILRKAADMPTMDHRSSMFGEILHPALAGVKQVLKTETASVFIFPATGSGGWET<br>AITNTLSPGDRVLAGRHGMFSHKWIDMCRRYQLKVDAIESSWHDGVPLAQYEELLNGDKAHEIKAVLVTH<br>NETATGVKSDVAAVRRLLNAANHPALLLVDGVSSIASMDFRMDEWGVDVAVTGSQKGFMLPVGLAITAF<br>SAKAMAALETAKFPRAFFDVRDMAKGYSTNGYPYTPSVGLLNGLKVSTELLLQEGLENVFARHRRIASGV<br>RAAVRAWRLELYAAREELYSDTVTAVQTPAGFDASRFVTHAATKYDVAFGAGLGDVAGKVFRIGHVGSM<br>TDVMALSGIATAEMVMVDLGLNIKLGSGVAAAQAIYRNSQSSAFYMVA |
| 434 | MYGQNPVFIPGPTNMPEILRKAADMPTMDHRSSMFGEILHPALAGVKQVLKTETASVFIFPATGSGGWET<br>AITNTLSPGDRVLAGRHGMFSHKWIDMCRRYQLKVDAIESSWHDGVPLAQYEELLNGDKAHEIKAVLVTH<br>NETATGVKSDVAAVRRLLNAANHPALLLVDGVSSIASMDFRMDEWGVDVAVTGSQKGFMLPVGLAITAF<br>SAKAMAALETAKFPRAFFDVRDMAKGYSTNGYPYTPSVGLLNGLKVSTELLLQEGLENVFARHRRIASGV<br>RAAVRAWRLELYAAREELYSDTVTAVQTPAGFDASRFVTHAATKYDVAFGAGLGDVAGKVFRIGHVGSM<br>TDVMALSGIATAEMVMVDLGLNIKLGSGVAAAQAIYRNSQSSAFYMVA |
| 435 | MYLQNPVFIPGPTNMPEVLRKASDMPTIDHRSPLFGEILRPALAGVKKIVKSDAASIFVFPATGTGGWETAI<br>TNTLSPGDRVLVARYGMFSHRWIDMCQRHGLDVSVIETSWGSGAPVDRYEEMLTADKAHQIKAVLVTHN<br>ETATGVKSDIAAVRRALDATRHPAMLFVDGVSSIASMEFRMDDWGVDVAVTGSQKGFMLPAGLAITAFS<br>PKALAALETAKLPRTFFDIRDMSKSYENNAYPYTPAVGLLNGLKVSTEMLLAEGLENVFARHKRIATGVRA<br>AVRAWGLELCARSEDLYSDTVSTIRTPDGFDATSVVTHAAKKYDVAFGVGLGEVAGKVFRIGHLGSLTDV<br>MALSGIATAEMVMADLGLAIKLGSGVAAAQEYYRSNQVSAGRGAA |
| 436 | MSGYNHLFIPGPTNIPERVRQAMNLPMEDMRSPRYPELTLPLFADIKEVFKNKTGRVFIYPSSGTGAWEA<br>AMTNVLSPGDRVLMSRFGQFSHLWVDMAERLGFEVDCLDREWGTGVPVELYAERLAADKAHEIKAVFV<br>THNETATGVTSDVAAVRAALDACGHPALLFVDGVSSIGSIDFRQDEWGVDCAVSGSQKGFMMPAGLGFL<br>SVSQKALEAARTARHMRCYFSFEDMIKTNDTGYFPYTPPTQLLRGLRAALDLIFEEGLETIFARHHHLANG<br>VRAAVSAWGLKLCATEPKWHSDTVSAIRLPEGIDGVEVIRHAYQTYNTSLGSGLSKVAGKVFRIGHLGSL<br>NEVMVLGALSAAELTLLDCGVKIEPGAGVGAAISQFRSAAVSSAKAA |
| 437 | MAGYNHLYIPGPTNVPEEVRMAMNVCMQDMRAPDFPNFTKPLFAKVQKVFKNTTGRVFLYPSSGTGAW<br>EEAAIQNTLSPGDKVLMSRFGQFSHLWVDMAQRLGLDVEVIECEWGEGVPVEKYATRLKADPGHEIKAVF<br>ATHNETATGVSSDIKGVRAALDAANHPALLMVDGVSSIGSIEFDQDAWGVDCAVSGSQKGFMLPAGIGIL<br>SVSKWALEAHKHAEYPRTFFSFEDMIATNDQGYFPYTPATQLLRGLDVACDMIHAEGLENIWARHHRLAS<br>GVRAAVDAWGLKLCAKEAKWHSNTVSAILVPDGVDARDVIATGYSKYNTSFGTGLSKVMGRVFRIGHLG<br>WLNEGMVSTALSVAEMSMIDVGMNIKAGSGVGAAIDYFTSTAAKSGKAIAAE |
| 438 | MSIQNPVFIPGPTNIPESVRKACDMPTIDHRSPLFATILHPAIDGCRKVLKTTEGELFIFPASGTGGWEASL<br>TNTLNPGDTILAARNGMFSHKWIDMCHRFGLNVIQVDVPWGEGLPVPKFEEILRADPDGRIKAVLATHNE<br>TATGVVSDVAGLRRAMDAAGHGALLMVDGVSSIGSMNFEFDNWGVDVAVTGSQKGFMLPAGLAITCFS<br>PKAIAASKTATLPRTFWSIDDMRNGYAANAYPYTPSVGLLNGLKHTTEMLLAEGLDNVFARHARIADGVR<br>AAVRAWGMTPCAVSPDLYSNTVTAICTPEGFNASTIVERASLQYGMAFGTGLGDVAGKVFRIGHLGMLT<br>DAMALSGIATAEMVMVDLGLPVTLGSGVAAAQEIYRKGGKIQKEQAA |
| 439 | MSVQNPIFIPGPTNIPEVLRKAVDMPTIDHRSSLFGQILRPAIDGAKKVFKTTDGQLFIFPSTGTGGWEIAIT<br>NVLSPGDKVLATCNGMFSQRWIDMCRRHQLDVTMIQQAWGDGISAERVEKILAADKHHRISVVLATHNE<br>TATGVKSDIAALRRSLNATKHPALLFVDGVSSIGSMDFRMDEWGVDVAVSGSQKGFMLPPGLAIVGFSA<br>RALEATENARLPRTFFDIRDMAKSNALNGFPYTPPVGLLNGLKLSTEMLLEEGLDNVFARHHRIAEGVRA<br>AISAWGMQLCALRPELYSDTVSAICVPDGFDANKIVARALNAYGVAFGTGIGAVAGKVFRIGHLGSLTEAM<br>ALSGIATAEMTMVDLGLPITLGAGTAAAQQHFRLSIESTQRKAA |
| 440 | MSFQNPVFIPGPTNIPESLRKACDMPTIDHRSPLFGQILHPARKAVQQILKSTSAEVFIFPASGTGGWETAL<br>TNTLSAGDTVLVARNGMFSHRWIDMCERFGLDVIIVDVAWGNGIPADRYEEILTKDTAHRIKAVLATHNET<br>ATGVKSDIAAVRRAMDAAKHPALLMVDGVSSIASMDFRFDEWGVDVAVTGSQKGFMLPAGLAIVGFSQK<br>AMEATKTAGLFRTFFDVHDMMKGYANNAYPYTPAVGLMNGLNEACRMLQAEGLENVFARHIRIAEGVRA<br>AVDAWGLKLCAETPDVYSDTVSAIRTPEGFNASDIVSHAATTYGVAFGTGLGDVAGKVFRIGHLGSLTDV<br>MALSGIATAEMCMVDLGLDIKLGSGVAAAQDYYRQGSNIAQKVAAE |
| 441 | MSDQNPVFIPGPTNIPDRLRNAMHIQTRDHRAPDFVETFAPVLEDCKRVFGTETGQVITFPASGTGGWEA<br>SICNTLSAGDTVLVARYGMFSHRWIDLCQRHNLEVQVIDCEWGSGAPADLFEQALKADTDKTIKAVLVTH<br>NETATGVKSDIAAVRRAMDAASHPAMLFVDCVSSLASMPFHMDDWGVDIAVSGSQKGFMLATGMAILGV<br>SQKALAAMETATLPRTFFDFRDMMAANASGGFPYTPPLQLIYGMRESLKMLLEEGLDNVYARHFRLAEG<br>VRKAVEAWGMKLCAQSPELYSDTVSAIYVPEGFDSNELTEHAFNAYGVSFGIGLGEMNGKAFRIGHLGSL<br>TDVMVLSGLATIEMAMADLNYPFELGSGVRAAQEYYRATAAANQ |

FIG. 12AL

| | |
|---|---|
| 42 | MSFQNPVFIPGPTNMPEALRRACDMPTLDHRSPLFGQILQPALAGVKKVLKTETAEVFLFPSTGTGGWET AITNCLSPGDKILAARNGMFSHRWIDMCQRHGLKVEVVEAPWGTGLPADRYEEILTADTSHEIKAVLATH NETATGVKSDIAAVRRALNAAKHPALFFVDGVSSIASMDFRMDEWGVDAAVTGSQKGFMLPPGLAIIALS PKAQAAVESARLPRTFFDVRDMMKAYASNAYPYTPAVGLMNGLKQSCDMLLAEGLENVFARHHRIAEGV RAAVRAWGLELCARSPDIYSDSVSAIRTPEGFNATGIVTHAAAKYGVAFGVGLGEVAGKVFRIGHLGSLT DVMMLSGLATAEMVMADLGLDIKLGSGVAAAQEVYRSDSAIASKEAA |
| 43 | MLSPTGGDRMSNQNPVFIPGPTNMPDRLRLKMLAQTMDHRAPDFAGVFRPMLEDTKKVFGTAEGEVIAF PGSGTGGWEAAVANTLSPGDKVLVARYGLFSHKWIDLCQRFGLDMQVIDVPWGEGAPAARFEEILSADT GHEIKVVLVTHNETATGVLSDVGAVRRAMDAARHPAMMFVDCVSSLASVPFHFDAWGVDVAVSGSQKG FMLPAGMAITCVSKKAMAATEHARLPRCYFDFRDMLASNAKGGFPYTPPLQLIYGMREALDMLFEEGLE AVYARHVRLAEGVRRAVSAWGMELVAASPDLYSPTVSAVRVPEGFDSNALTEHAYIAYGVSFGVGLGQL DGKAFRIGHLGMLTDVMVLSGLATVEMAMADLGYPVRLGSGVAAAQEHYRSSRGAGALRDAA |
| 44 | MEDWMMSFQNPVFIPGPTNMPEAIRKACDMPTIDHRSPLFGQILHPARAGVQEILKSETAEIFIFPSTGTG GWETALTNTLSAGDTILAARNGMFSHRWIDMCLRHELNVKIVETPWGHGLPADRYAEILKADTEHKIKAVL ATHNETATGVKSDIAAVRKALDAANHPAMLFVDGVSSIGSMDFRFDEWGVDVAVTGSQKGFMLPAGLAI VGFSQKALDASKTAGLPRTFFDIADMSKGYAANAYPYTPAVGLMNGLLLATETLLKEGLDNVFARHTRIAS GVRAAVDGWGLELCAATPDIYSDTVSAIKTPEGFNATDIVTHAADKYGVAFGVGLGEVAGKVFRIGHLGS MTDVMALSGIATAEMCMVDLGLDIKLGSGVAAAQEYYRTSTGLSLEDAA |
| 45 | MSFQNPVFIPGPTNMPEELRKAVDMPTLDHRSPLFADILHPALEGVKAVLKSQTAEVFVFPGTGTGGWET AISNTLSAGDAVLAARNGMFSHRWIDLCQRHGLDVQVIEAGWGAGLPADRYEEVLAADTGHRIKAVLATH NETATGVVSDIAAIRRAMDAASHPALLLVDGVSSIGSMDFRMDEWGVDIAVTGSQKGFMLPAGLAIVAFS PRAMQAVEGATLHRTYFDIRDMARGYAAGAYPYTPAVGLLNGLKMATGMLLDEGLDNVFARHHRIAGGV RRAVHAWGLELCADSPDLWSDTVSAIRMPEGVDANRFVAHAVERYGVAFGTGLGELAGKAFRIGHLGR MTDVMALSGIATAEMVMADLGMDIALGSGVAAAQAHYRLDPATTTRKEAA |
| 46 | MSNQNPVFIPGPTNIPDRLRLAMQVQTQDHRAPDFVETFAPVLEDTKKVFKTTDGQIVTFPASGTGGWE AAITNTLSPGDKVLVARYGVFSHRWIDLCERHGLDVQIVECPWGTGAPADKFEEILAADKAHQIKAVLVTH NETATGVRSDIGAVRRAMDAASHPAMMFVDCVSSLASMPFEFDQWGVDIAVSGSQKGFMLATGMAILC VSPKALAAMESAKLPRTFFDFRDMMAANASGGFPYTPPLQLIYGMGESLKMLFEEGLDNVYARHTRLAE GVRRATRAWGMELVAQSPDLYSDTVSAVYVPEGFDSNELTDHAFNAYGVSFGIGLGQMDGKAFRIGHL GSLTDVMVLSGLATIEMAMADLSYPVELGSGVAAAQEFYRTGSSKHTKAAA |
| 47 | MSFQNPVFIPGPTNIPESLRKACDMPTIDHRSPLFGQILHPARDGVRKVLKSETAEVFIFPSSGTGGWETA LSNTLSAGDNVLAARNGMFSHRWIDMCQRHGLEVQIVETPWGAGLPADRYEEILSADKAHKIKAVLATHN ETATGVKSDIAAVRRALDAAGHPALLFVDGVSSIASMDFRMDEWGVDVAVTGSQKGFMLSAGLAIVGFS PKAMEATKSAQLPRTFFDVHDMAKGYANNAYPYTPAVGMMNGLNESCKMLLAEGLENVFARHHRIAEG VRAAVGAWGLELCAATPEVYSDTVSAIRTPEGFNATDIVTHAADKYGVAFGVGLGEVAGKVFRIGHLGSL TDVMALSGIATAEMCMVDLGLDIQLGSGVAAAQEYYRGNAVSAQQDAA |
| 48 | MSFQNPVFIPGPTNIPERLRKACDMPTIDHRSPLFGQILHPAREGVRKVLKSDSAEVFIFPSTGTGGWETA LSNCLSAGDTVLAARNGMFSHRWIDMCQRHGLNVEIVETPWGHGLPADRYEEILTADTGHRIKAVLATHN ETATGVKSDIAAVRRALDAAGHPALLFVDGVSSIASMDFRFDEWGVDVAVAGSQKGFMLPPGLAITGFSA KAMEATKTATLPRTFFDVADMAKGYANNAYPYTPAVGLLNGLNEACGMLLAEGLESVFARHHRIAEGVR AAVGAWGLELCAVSPDVYSDTVSAIRTPEGFNATRIVEHAASAYGVAFGTGLGEVAGKVFRIGHLGSLTD VMALSGIATAEMVMADLGLDIRLGSGVAAAQDYYRANRAPLRAAA |
| 49 | MTSQNPIFIPGPTNIPEEMRKAVDMPTIDHRSPVFGRMLHPALEGVKKVLKTETALVFLFPSTGTGGWETA ITNTLSPGDKVLAARNGMFSHRWIDMCQRHGLDVTYVETPWGEGIPADRFEEILTADKGHEIRVVLATHN ETATGVKSDIAAVRRALDAAKHPALLFVDGVSSIGSMDFRMDEWGVDIAVTGSQKGFMLPPGLAIVGFSP KAMEAVESARLPRTFFDIRDMATGYARNGYPYTPPVGLINGLNLSCERLLAEGLENVFARHRRIAGGVRA AVEAWGLKLCAVRPELYSDSVSAIRVPEGFDANLIVSHALETYDMAFGTGLGQVAGKVFRIGHLGSLTDA MALSGIATAEMVMADLGLPIRLGSGVAAAQEHYRQTTAAAQKKAA |
| 50 | MTSQNPIFIPGPTNIPEEMRKAVDMPTIDHRSPVFGRMLHPALEGVKKVLKTETAQVFLFPSTGTGGWET AITNTLSPGDKVLAARNGMFSHRWIDMCQRHGLDVTYVETPWGEGIPADRFEEILTADKGHEIRVVLATH NETATGVKSDIAAVRRALDAAKHPALLFVDGVSSIGSMDFRMDEWGVDIAVTGSQKGFMLPPGLAIVGFS PKAMEAVESARLPRTFFDIRDMATGYARNGYPYTPPVGLINGLNLSCERLLAEGLENVFARHRRIAGGVR AAVEAWGLKLCAVRPELYSDSVSAIRVPEGFDANLIVSHALETYDMAFGTGLGQVAGKVFRIGHLGSLTD AMALSGIATAEMVMADLGLPIRLGSGVAAAQEHYRQTTAAAQKKAA |
| 51 | MSQQNPVFIPGPTNVPDRLRRVMDMQTLDHRAPDFADTFQPVLAGVKRILKASSAQVMLFPASGTGGW EEAAITNTLSPGDKVLAARYGMFSHRWIDLCQHHGLDVQVIDVEWGEGAPVEQYAEALQADSNHEIKAVLA CHNETATGVVSDIAGLRNALDDTGHPALLFIDGVSSIASMDFRFDEWGVDIAITGSQKGFMLYTGMAIVAV SEKALQAMESARLPRCFLDFRDMLNANAQGSFPYTPPLQLIFGLSESIKMLEEEGLENVFARHHRLAEGV RQAAQAWGLPLCAKRPELYSDSVTAIHVPDGFDATALINHAYAAYGVSYGVGLGEVAGKVFRIGHLGSLT DVMALTGISTIEMAMHELGYPIQLGAGTAAAQAYYSKTRGELRAMAA |

FIG. 12AM

| | |
|---|---|
| 452 | VSAQNPVFIPGPTNMPEALRKACDMPTIDHRSAVFGEILAPCLAGVRRVLKSERAQVFLFPSTGTGGWET AISNTLSPGDKVLAARHGMFSHRWIDLCQRHGLSVQVVEAPWGAGLPADRYAEILAADTAHEIKAVLATH NETATGVRSDIAAVRRTLDAAGHPALLLVDGVSSIASMDFRMDQWGVDVAVTGSQKGFMLPAGLAIVAF SDKAWRATETAKLPRTFFDVRDMGQSYARNGFPYTPPVGLMNGLRLSTEMLLKEGLENVFARHRRIADG VRAAVAAWEMPLCAEGPELWSDTVSAIRTPEGFDATKIVTHAAAKYGVAFGVGLGEVAGKVFRIGHLGSL TDVMMLSGLATAEMAMADLGLPVRLGSGVAAAQEVYRASEAKLEKAAA |
| 453 | MSLQNPVFIPGPTNIPEALRKACDMPTIDHRSSVFPQILQPALAGVKRVLKTEAGEAIVFPGTGTGGWEAA ISNTLSPGDKVLAANFGMFSAKWIDMCRRHGLEVQVVEAPWGAALPVATFAEILAADTGHEIRAVLATHN ETATGVRSDIAGLRAAMNAADHPALLFVDGVSSIASMDFRMDEWGIDVAITGSQKGFMLPAGLAIVAVSR KAVAAMERATLPRFYFDFRDMLAMNPASGYPYTPVVGLLNGLKASIEMLEAEGLDAVFARHAHIADGVRV AVGAWGLRFCAIAPDARSDTVTAIVLPDGIDGNAFVAHAETRYGTSFGAGLGAVAGKVFRIGHLGQLSET QALAGIATAEMVLADLGVDIALGSGVAAAQGVYRSAVKGHGSARAAA |
| 454 | MFAQNPVFIPGPTNMPEVLRRAADMPTLDHRSPLFAQILHPALAGVKTVLKSQDAEVFVFPSTATGGWET ALSNTLSAGDAVLAARHGMFSHRWIDMTRRHGLDVRVIEAPWGEGLPADRFAEALAADTAHRIRAVLVT HNETATGVRSDVAAVRRALDASGHPALLLVDGVSSIASMDFRMDEWGVDVAVTGSQKGFMLPAGLAIVA FSPRAMAATATATLPRTYFDVRDMAKGYPNGAYPYTPAVGLLNGLKLSTELLLAEGLDNVFARHRRIADG IRAAVAAWGLELCAARPDLYSDTVSAIRTPEGFDATRIVTHAARHYDVAFGVGLGEVAGKVFRIGHLGSLT DVMALSGIAAAEMAMADLGLRIELGSGVAAAQAVYRRAPAAGLRAAA |
| 455 | MHMQNPVFIPGPTNMPEVLRKASDMPTIDHRSSLFGEILRPALAGVQKVVKSEAASIFVFPATGTGGWET AITNTLSPGDRVLAARNGMFSHRWIDMCQRHGLNVEIILASWGSGAPAERYEEILVADKAHEIKAVLVTHN ETATGVRSDIAAVRRAIDAARHPAMLFVDGVSSIASLDFRMDEWGVDVAVTGSQKGFMLPAGLAITAFSP KALAALETAKLPRTFFDVRDMAKSYAGNAYPYTPAVGLLNGLKVSTEILLEERLENVFARHKRIASGVRAA VGAWGLELCATSEDLYSDTVSAIRTPEGFDATSVVTHAAKKYDVAFGVGLGEVAGKVFRIGHLGSLTDVM ALSGIATAEMVMADLGLPIKLGSGVAAAQQYYRENDVSAVRKSAEEI |
| 456 | MSGYNHLFIPGPTNIPEQVRQAMNLPMEDMRSPRYPELTLPLFADVKKVFKNRNGRVFIYPSSGTGAWE AAMTNVLSPGDKVLMSRFGQFSHLWVDMAERLGFEVDCLDREWGTGVPVKLYAERLAADKAHKIKAVF VTHNETATGVTSDVAAVRAALDACGHPALLFVDGVSSIGSIDFRQDEWGVDCAVSGSQKGFMLPAGLGF LSVSQKALDAAKTARHMRCYFSFEDMIKTNDTGYFPYTPPTQLLRGLRAALDLIFEEGLENIFARHHHLAD GVRAAVSAWGLKLCATEPKWHSDTVSAIRLPEGVDGVEVIRHAYRTYNTSLGSGLSKVAGKVFRIGHLGS LNEVMVLGALSAAELTLLDCGVKIEPGVGVGAAIRQFRSAAATATAEAA |
| 457 | MSFQNPVFIPGPTNIPERLRKACDMPTIDHRSPLFGQILHPAREGVRKVLKSESAEVFIFPSTGTGGWETA LSNCLSAGDTVLAARNGMFSHRWIDMCQRHGLDVEIVETPWGQGLPADRYEEILTADTGHRIKAVLATH NETATGVKSDIAAVRRALDAAGHPALLFVDGVSSIASMDFRFDEWGVDVAVTGSQKGFMLPPGLAITGFS PKAMAATRTATLPRTFFDVADMAKGYANNAYPYTPAVGLLNGLNEACGMLLSEGLDNVFARHHRIAEGV RAAVKAWGLELCAASPEVYSDTVSAIRTPEGFDATRIVEHAASAYGVAFGTGLGEVAGKVFRIGHLGSLT DVMALSGIATAEMVMADLGLNITLGSGVAAAQDYYRANRTALQAAA |
| 458 | MYMQNPVFIPGPTNMPEILRKAADMPTLDHRSPLFGQILRPALAGVKKILKTEAASVYVFPSTGTGGWET AITNTLSPGDRVLAARYGMFSQRWIDMCQRHGLKVDIIEAAWGGGAPAARYEEILAADTAHEIKAVLVTHN ETATGVKSDIAAVRRAIDAARHPALLFVDGVSSIASMDFRMDEWLVDIAVTGSQKGFMLPAGLAITAFSPK ALAAVETAKLPRTFFDIGDMARSYANNAYPYTPAVGLLNGLKLSTELLLAEGLENVFARHRRIASGIRAAV RAWGLELCAMSEDLYSDTVSAIRTPEGFDATSIVAHAAKTYDVAFGVGLGEVAGKVFRVGHLGSLTDVM ALSGIATAEMVMVDLGLDIKLGSGVAAAQDYYRDGRTSKVRAAA |
| 459 | VSFQNPVFIPGPTNMPEEIRLATYMPTIDHRSPVFGGILHPCLDGVRRVLKSETAHIFIFPSTGTGGWETTL TNTLSAGDKVLVARNGMFSHRWIDMCERHGLDVQVVDVAWGEGLPVAEYAAILKADKDHTIKAVLATHN ETATGVKSDIAGVRGALDAANHPALFFVDGVSSIGSMDFRMDEWGVDVAVTGSQKGFMLPAGLAIVGFS EKARAAVESATLPRTFFDIRDMEKGYAANAFPYTPPVGLMNGLKCAIEMIEAEGLENVFARHTRIATGVRH AVEAWGLELCANAPELYSDSVSAIRTPEGFNATDIVTRADEQYGMAFGVGLGDVAGKVFRIGHLGMLTD AMMLSGLGVAEMVMKDLGLDIKLGSGVGAAQEFYRYGS |
| 460 | MTSQNPIFIPGPTNIPEEMRKAVDMPTIDHRSPVFGRMLHPALEGVKKVLKTTQAQVFLFPSTGTGGWET AITNTLSPGDKVLAARNGMFSHRWIDMCQRHGLDVTFVETPWGEGVPADRFEEILTADKGHEIRVVLATH NETATGVKSDIAAVRRALDAAKHPALLFVDGVSSIGSMDFRMDEWGVDIAVTGSQKGFMLPPGLAIVGFS PKAMEAVETARLPRTFFDIRDMATGYARNGYPYTPPVGLINGLNASCERILAEGLENVFARHHRIASGVRA AVDAWGLKLCAVRPELYSDSVSAIRVPEGFDANLIVSHALETYDMAFGTGLGQVAGKVFRIGHLGSLTDA MALSGIATAEMVMADLGLPIQLGSGVAAAQEHYRQTTAAAQKKAA |
| 461 | MTSQNPIFIPGPTNIPEEMRKAVDMPTIDHRSPVFGRMLHPALEGVKKVLKSTQAQVFVFPSTGTGGWET AITNTLSPGDKVLAARNGMFSHRWIDMCQRHALDVTFVETPWGEGVPADRFEEILTADKGHEIRVVLATH NETATGVKSDIAAVRRALDAAKHPALLFVDGVSSIGSMDFRMDEWGVDIAVTGSQKGFMLPPGLAIVGFS PKAMEAVETARLPRTFFDIRDMATGYARNGYPYTPPVGLINGLNLSCERLLSEGLENVFARHNRIASGVR AAVGAWGLKLCAVRPELYSDSVSAIRVPEGFDANRIVSHALETYDMAFGTGLGEVAGKVFRIGHLGSLTD AMALSGISVAEMVMADLGLPIKLGSGVAAAQEHYRQTAAAAQKKAA |

FIG. 12AN

| | |
|---|---|
| 460 | MSDQNPVFIPGPTNIPDRLRRAMQVQTQDHRSPAFVNTLTPVLAGCLTVFGASEAEIITFPASGTGGWEAAITNTLSPGDTVLVARYGMFSHRWIDMCARHGLNVQIIECPWGSGAPADKFEAALRADTAHKIKAVLVTHNETATGVRSDIGAVRGAMDAAAHPALLMVDCVSSLASMPFEMDAWGVDIAVAGSQKGFMLNTGMAILAVSDKALAAMDSATLPRTFFDFRDMLTTNAKGGYPYTPPLQLIYGMAESLNMLFEEGLENVYARHTRLAEGVRRAVEAWGLRLVAQSPELYSDTVSAIYVPDGFDSNALTEHAFATYGMSFGVGLGEMNGRAFRIGHLGSLTDAMMLSGLATIEMAMADLNYPVKLGSGVIAAQDYYRKTAKPVLTEQAA |
| 463 | MTSQNPVFIPGPTNMPEAVRLACHMPTMDHRSPAFADILHPCLDGVRRVLKSTEVEVFIFPSTGTGGWETAISNTLSPGDRVLVARNGMFSHRWIDMCQRHGLDVQIVETPWGHGIPVSTYEEILRADTGHAIKAVLATHNETATGVKSDIAGVRRAMEAAGHPALLMVDGVSSIGSMDFRFDEWGVDIAVTGSQKGFMLPAGLAILGFSPRAMAATKTAKLHRTFFDVADMAKGYANNAFPYTPPVGLMNGLKLACDMLLSEGLENVFARHHRMAEGVRRAVDAWDLKLCAASPDVWSDSVSAICTPAGFNATDVVTVAARDYDMAFGVGLGEVAGKVFRIGHLGMLTDAMMLSGLAVAEMAMVDLGLPIKLGSGVAAAQDYYRHGNTQQKAAAE |
| 464 | MSQQNPVFIPGPTNIPDRLRLAMQVQTQDHRAPDFVETFAPVLEDTKKVFGTDQGQVITFPASGTGGWEAAVTNTLSPGDAVLVARYGMFSHRWIDLCQRHGLDVRIIECPWGSGAPAQKFAEALAADNSHEIKAVLVTHNETATGVRSDIAAVRKAMDASTHPALLFVDCVSSLASMPFEFDDWGVDIAVSGSQKGFMLATGMAILCVSPKALAAMETANLPRTFFDFRDMMNANASGGFPYTPPLQLIYGMRESLKMLFEEGLDNVYARHFRLAEGVRKATSAWGLELVAQSPDLYSDTVSAIFVPDGFDSNALTDHAFNAYGVSFGIGLGEMNGKAFRIGHLGSLTDVMVLSGLATIEMAMADLDYPIELGSGVAAAQAYFRVGHATPMQSAA |
| 465 | MYSQNPVFIPGPTNMPEILRKAADMPTLDHRSPLFGQILRPVLAGVKKILKTEDAEIFLFPSTGTGGWETALTNTLSAGDGVLAARYGMFSHRWIDMCRRHGLDVTVVETSWGSGLPADRYEEILTADKEHRIKAVLATHNETATGVRSDIAAVRRALDAAKHPAMLMVDGVSSIASMDFRMDEWGVDIAVTGSQKGFMLPAGLAIVAFSSKAMDATAAAGLPRTFFDVRDMARNYANGGYPYTPAVGLLNGLKVSTELLLGEGLDNVFARHRRIASGIRAAVKAWGLELCAQSEDLYSDTVSAIRTPEGFNASDIVSHAARKYDIAFGVGLGDVAGKVFRIGHLGSLTDVMALSGVAAAEMAMVDLGLGIKLGSGVAAAQEYYRGADAAQIRVAA |
| 466 | MSDQNPVFIPGPTNIPDRVRHAMNVQTRDHRSPDFVKTFAPVLEDCKRVFGTEAGQVITFPSTGTGGWEAAICNTLSAGDTVLIARYGMFSHRWIDMCQRHDLHVEVIECPWGSGAPADLFRERLNKDSAHKIKAVLVTHNETATGVLSDIGAVRKAMNTTSHPAMLFVDCVSSLGSMPFKMDAWGVDIAIAGSQKGFMLTTGMAILAASPKALAAIETAQLPRTYFDFRDMMAANKNGGFPYTPPLQLIYGLKESLTMLFDEGLDNVYARHFRLAEGVRQAVAAWGFKLCANAPELYSHSVSAIYVPEGFDSNKLTDHAFNAYGVSFGIGLGEMNGKAFRIGHLGSLTEVMVLSGLAAIEMAMADLDYPITLGSGVAAAQEYFRKTAAANIG |
| 467 | MSFQNPVFIPGPTNIPESLRKACDMPTIDHRSPLFGQILHPAREGVRKVLQSESAEIFIFPSTGTGGWETALSNTLSSGDTVLAARNGMFSHRWIDMCQRQRLRVEIVETPWGEGLPADRYAEILAADKHHRIKAVLATHNETATGVRSDIAAVRHALDAAGHPALLFVDGVSSIGSMDFRFDEWGVDCAVTGSQKGFMLPPGLAIVGFSEKAMEATKIAMLPRTFFDVHDMAKGYANNAYPYTPAVGLMNGLNEACRMLLDEGLENVFARHHRIAEGVRCAVRAWGLNLCAASPDIYSDTVSAIRTPKGFNATDIVSHAAQTYGVAFGTGLGEVAGKVFRIGHLGSLTDVMMLSGLATAEMCMADLGLDITLGSGVAAAQEFYRATPALSRKVAAE |
| 468 | MHMQNPVFIPGPTNMPEVLRKASDMPTIDHRSSLFGEILRPALAGVQKVVKSEAASIFVFPATGTGGWETAITNTLSPGDRVLAARNGMFSHRWIDMCQRHGLNVEIILASWGSGAPAERYEEILVADKAHEIKAVLVTHNETATGVRSDVAAVRRAIDAARHPALLFVDGVSSIASMDFRMDEWGVDVAVTGSQKGFMLPAGLAITAFSPKALAALETAKLPRTFFDVRDMAKSYAGNAYPYTPAVGLLNGLKVSTEILLAEGLENVFARHTRIASGVRAAVGAWGLELCATSEDLYSDTVSAIRTPEGFDATSVVTHAAKKYDVAFGVGLGEVAGKVFRIGHLGSLTDVMALSGIATAEMVMADLGLGVRLGSGVAAAQEYYRNNQVSAVQGTA |
| 469 | MSFQNPVFIPGPTNMPEALRKAVDMPTLDHRSPLFGQILHPALAGVKKVLKSESAEIFVFPSTGTGGWETAITNTLNSGDKILAARNGMFSHRWIDMCQRHGLDVQVVETPWGEGLPADRYEEILTADTSHQIKAVLATHNETATGVKSDIAAVRRALDAAGHPALLFVDGVSSIASMDFRMDEWGVDIAVTGSQKGFMLPPGLAIVGFSPKAMKAAETATLPRTFFDIKDMANGYANSAYPYTPSVGLLNGLNMACGMLLDEGLENVFARHHRIAEGVRAAVRAWGLELCAVSPDVYSDSVSAIRTPDGFDANKFVSLAAEKYGVAFGTGLGEVAGKVFRIGHLGSLTDVMALSGIATAEMVMADLGLNIQLGSGVAAAQDYYRGNTASSTKAAA |
| 470 | MSFQNPVFIPGPTNMPEALRKAVDMPTLDHRSPLFGQILHPALAGVKKVLKSESAEIFVFPSTGTGGWETAITNTLNAGDKILAARNGMFSHRWIDMCQRHGLDVQIVETPWGEGLPADRYEEILTADTAHEIKAVLATHNETATGVKSDIAAVRRALDAAGHPALLFVDGVSSIASMDFRMDEWGVDIAVTGSQKGFMLPPGLAIVGFSPKAMKAAETATLPRTFFDIKDMANGYANSAYPYTPSVGLLNGLNMACGMLLDEGLENVFARHHRIAEGVRAAVHAWGLELCAVSPDVYSDSVSAIRTPDGFDANKFVSLAAEKYGVAFGTGLGEVAGKVFRIGHLGSLTDVMALSGIATAEMVMADLGLNIQLGSGVAAAQDYYRGNTASSTKAAA |
| 471 | MSFQNPVFIPGPTNMPEAIRKACDMPTIDHRSPLFGQILHPARAGVQKILKSETAEVFIFPSTGTGGWETALTNTLSAGDTVLAARNGMFSHKWIDMCLRHELNVKIVETPWGHGLPAGRYAEILMADTEHKIKAVLATHNETATGVKSDIAAVRKALDAANHPAMLFVDGVSSIGSMDFRFEEWGVDVAVTGSQKGFMLPAGLAIVGFSQRAMDASKTAGLPRTFFDIADMTKGYEANAYPYTPAVGLMNGLLLATETLLKEGLDNVFARHNRIASGVRAAVDAWGLGLCAATPDVYSDTVSAIKTPEGFNATDIVAHAADKYGVAFGVGLGEVAGQVFRIGHLGSMTDVMALSGIATAEMCMVDLGLDIKLGSGVAAAQEYYRGTTGLSLKDAA |

FIG. 12AO

| | |
|---|---|
| 472 | MSFQNPVFIPGPTNIPENLRKACDMPTIDHRSPLFGSILHPALDGVRQILKTTKAEVFIFPASGTGGWETAITNTLSAGDTILVARNGMFSHRWIDLCERHGLNVQIVETNWGDGISAEKYAEILSKDKALKIKAVLATHNETATGVKSDIASIGRAVKSVNHPALFMVDGVSSIGSMDFQFDNWGVDVAVTGSQKGFMLPAGLAILGFSERAMAATKSGTLHRTFFDVHDMQAGYANNAYPYTPAVGLMNGLNEACKMLLDEGLDNVFARHTRIASGVRAAVSAWGLELCATAPEFYSDTVSAIRTPAGFNATDIVTHAAETYGVAFGVGLGEVAGKVFRIGHLGSLTDVMALSGIATAEMCMVDLGLDIELGSGVAAAQEVYRAGPAIENRKVA |
| 473 | MSFQNPVFIPGPTNIPESLRKSCDMPTIDHRSPLFGGILNAARDGVRQVLKSETADVFIFPATGTGGWETALTNTLSHGDTVLAARNGMFSHRWIDMCQRLRLDVRVVETPWGHGIPHAQFAEILAADTSHQIKAVLATHNETATGVTSDIAAVRNAMDASDHPALLFVDGVSSIGSIDFQFDGWGVDVAVTGSQKGFMLPAGLAIVGFSAKAMAAQPSAQLPRTFFDIRDMADGYAAGAYPYTPAVGLMNGLSHACTMLLSEGLDTVFARHHHRIASGVRAAVSAWGLELCAASPDLYSDTVSAIRTPAGFDASRIVSHAATTYGVAFGGGLGEVAGKVFRIGHLGSLTDVMALSGIATAEMCMADLSLDITLGSGVAAAQQVYRAHGAANVQKDAA |
| 474 | MSFQNPVFIPGPTNMPDALRKACDMPTLDHRSPLFGEILQPALSGVKKILKSELAEVFIFPSTGTGGWETVITNTLSPGDKILAARNGMFSHRWIDLCQRHGLDVVIVDAPWGTGLPADRYEEILAADTHHEIKAVLATHNETATGVKSDIAAVRRALNNAKHPALLYVDGVSSIASMDFRMDEWGVDAAVTGSQKGFMLPAGLAIVGLSPKAQTAVDQAKLPRTFFDIRDMRKSYAVNAYPYTPAVGLLNGLKHSCDMLLSEGLDNVFARHHRIAEGVRAAVHAWGLQLCAGSRDVYSDTVSAIRTPEGFNATGIVTHAAGKYGVAFGVGLGEVAGKVFRIGHLGSLTDVMTLSGLATAEMVMADLGLSIKLGSGVAAAQDYYRTEEAVSSKEAA |
| 475 | MSFQNPVFIPGPTNMPEELRKAVDMPTLDHRSPLFAAILHPALDGVKAVLKSQTAEVFVFPGTGGWETAISNTLSAGDAVLAARNGMFSHRWIDLCQRHGLDVQVIEAGWGAGLPADRYEEILAADTGHRIKAVLATHNETATGVVSDIAAIRRAMDAAGHPALLLVDGVSSIGSMDFRMDDWGVDIAVTGSQKGFMLPAGLAIVAFSPRAMQAVEGATLHRTYFDIRDMARGYAAGGYPYTPAVGLLNGLKMATGMLLDEGLDNVFARHHRIAEGVRRAVHAWGLELCADSPDLWSDTVSAIRMPEGVDANRFVAHAVERYGVAFGTGLGELAGKVFRIGHLGRMTDVMALSGIATAEMVMADLGMDIALGSGVAAAQAHYRLDPATTTRKEAA |
| 476 | MSFQNPVFIPGPTNMPEALRRACDMPTLDHRSPLFGQILQPALAGVKKVLKTETAEVFLFPSTGTGGWETAITNCLSPGDNILAARNGMFSHRWIDMCQRHGLKVDVVEAAWGTGLPADRYEEILAADTNHEIKAVLATHNETATGVKSDIAAVRRALNAAKHPALLFVDGVSSIASMDFRMDEWGVDAAVTGSQKGFMLPPGLAIIALSPKAQAAVESARLPRTFFDVRDMMKAYANNAYPYTPAVGLMNGLKQSCDMLLAEGLDNVFARHHRIAEGVRAAVRAWGLELCAQTPDVYSDSVSAIRTPGGFNATGIVTHAAAKYGVAFGVGLGEVAGKVFRIGHLGSLTDVMMLSGLATAEMVMADLGLDIQLGSGVAAAQEVYRSDSAIASKEAA |
| 477 | MYGQNPVFIPGPTNMPEILRKAADMPTMDHRSSMFGEILHPALAGVKQVLKTETASVFIFPATGSGGWETAITNTLSPGDRVLAGRHGMFSHKWIDMCRRYQLKVDAIESSWHDGVPLAQYEELLNGDKAHEIKAVLVTHNETATGVKSDVAAVRRLLNAANHPALLLVDGVSSIASMDFRMDEWGVDVAVTGSQKGFMLPVGLAITAFSAKAMAALETAKFPRAFFDVRDMAKGYSTNGYPYTPSVGLLNGLKVSTELLLQEGLENVFARHRRIASGVRAAVRAWRLELYAAREELYSDTVTAVQTPAGFDASRFVTHAATKYDVAFGAGLGDVAGKVFRIGHVGSMTDVMALSGIATAEMVMVDLGLNIKLGSGVAAAQAIYRNSQSSAFYMVA |
| 478 | MTSQNPIFIPGPTNIPEEMRKAVDMPTIDHRSPVFGRMLHPALEGVKKVLKTTQAQIFLFPSTGTGGWETAITNTLSPGDKVLAARNGMFSHRWIDMCQRHGLDVTFVETPWGEGIPADRFEEILTADKGHEIRAVLATHNETATGVKSDIAAVRRALDNAKHPAMLFVDGVSSIGSMDFRMDEWGVDIAVTGSQKGFMLPPGLAIVGFSPKAMEAVESARLPRTFFDIRDMATGYARNGYPYTPPVGLINGLNASCERILAEGLENVFARHHRIASGVRAAVEAWGLKLCAARPELYSDSVSAIRVPEGFDANLIVSHALETYDMAFGTGLGQVAGKVFRIGHLGSLTDAMALSGIATAEMVMADLGLPIRLGSGVAAAQEHYRQTTAAAQKKAA |
| 479 | MSFQNPVFIPGPTNIPESLRKACDMPTIDHRSPLFGQILHPAREGVRKVLKSDSAEVFIFPSTGTGGWETALTNTLSPGDKVLAARNGMFSHRWIDMCQRHGLDVQIVEAQWGAGLPADRYEEILTADKGHEIKAVLATHNETATGVKSDIAAVRRALDAAGHPALLFVDGVSSIASMDFRFDAWGVDVAVTGSQKGFMLTAGLAITGFSEKAMAATGSATLPRTFFDIRDMETGYANNAYPYTPAVGLLNGLNEACRMLLDEGLENVFARHHRIAEGVRAAVRAWGLELCAISPEVYSDTVSAIRTPDGFNATDIVTHAANTYGVAFGVGLGEVAGKVFRIGHLGSLTDVMTLSGIATAEMCMADLGLDITLGSGVAAAQEYYRAHSALPQKDAA |
| 480 | MSNQNPVFIPGPTNIPDRLRLAMQVQTQDHRAPDFVETFAPVLEDTKKVFGTTEGQIITFPASGTGGWEAAITNTLSPGDKVLVARYGVFSHRWIDLCERHGLDVQIVECTWGTGAPADRFEAILSADKAHDIKAVLVTHNETATGVRSDIRAVRHAMNAANHPAMMFVDCVSSLASMPFEFDQWGVDIAVSGSQKGFMLATGMAILCVSPKALAAMETAKLPRTFFDFRDMMAANASGGFPYTPPLQLIYGMRESLKMLFEEGLDNVYARHTRLAEGVRRAANAWGLKLVAQTPDLCSDTVSAIYVPEGFDSNELTDHAFNTYGVSFGIGLGELNGKAFRIGHLGSLTDVMVLSGLATIEMAMADLNYPIELGGGVAAAQEFYRAGTSGHAKAAA |
| 481 | MSFQNPVFIPGPTNMPEALRRACDMPTLDHRSPLFGQILQPALAGVKKVLKTETAEVFLFPSTGTGGWETAITNCLSPGDKILAARNGMFSHRWIDMCQRHGLKVEVVEAAWGTGLPADRYEEILAADTNHVIKAVLATHNETATGVKSDIAAVRRALNAAKHPALLFVDGVSSIASMDFRMDEWGVDAAVTGSQKGFMLPPGLAIIALSPKAQAAVESARLPRTFFDVRDMMKAYANNAYPYTPAVGLMNGLKQSCDMLLAEGLDNVFARHHRIAEGVRAAVRAWGLELCAQTLDVYSDSVSAIRTPEGFNATGIVTHAAAKYGVAFGVGLGEVAGKVFRIGHLGSLTDVMMLSGLATAEMVMADLGLDIKLGSGVAAAQEVYRSDSAIASKEAA |

FIG. 12AP

| | |
|---|---|
| 482 | MFAQNPVFIPGPTNMPEVLRRAADMPTLDHRSPLFAQILHPALAGVKTVLKSQDAEVFVFPSTATGGWET ALSNTLSAGDAVLAARHGMFSHRWIDMTRRHGLDVRVIEAPWGEGLPADRFAEALAADTAHRIRAVLVT HNETATGVRSDVAAVRRALDASGHPALLLVDGVSSIASMDFRMDEWGVDVAVTGSQKGFMLPAGLAIVA FSPRAMAATATATLPRTYFDVRDMAKGYPNGAYPYTPAVGLLNGLKLSTELLLAEGLDNVFARHRRIADG IRAAVAAWGLELCAARPDLYSDTVSAICAPEGFDATRIVTHAARHYDVAFGVGLGEVAGKVFRIGHLGSLT DVMALSGIAAAEMAMADLGLRIELGSGVAAAQAVYRRAPAAGLRAAA |
| 483 | MSLQNPIFIPGPTNIPDRLRRAMNVPTQDHRAPDFSDTFLPVLADCKKVFGTQDSEIILFTSSGTGGWEAA ISNTLSPGDKVLIARYGMFSHRWIDMCQRHGLDVQVIECPWGTGAPADQFQAILSEDTAHEIKAVMVTHN ETATGVLSDIGAVRKAIDSSNHPALLFVDGVSSIASVPFEMDEWGVDVAVAGSQKGFMLATGMAILGVSQ KALSHMDEAKLPRTYFDFRDMLKANANGGFPYTPPLNLIYGLRESLEMLFDEGLENVYARHYRLAEGVR QAVSAWGMILCAKTPDLYSNTVSAIFVPEGFNSNKLTDHAFNKYGISFGIGLGEMNGKAFRIGHLGSLTEV MVLAGLAAIEMAMVDLDYPIKLGQGVAAAQEYYRNTATTK |
| 484 | MAVIPLVAVVVGDCMQNKKYFHVILLIRYEKIKIKQYHMFDYFINIMKIPFKKIAKADFLRHSMLISEEDGAMS DQNPVFIPGPTNIPDRLRRAMQVQTQDHRSPAFVNTLNPVLKGCKTVFSTTKGEIITFPASGTGGWEAAIT NTLSPGDKVLVARYGMFSHRWIDMCQRHGLDVQIIECPWGSGAPADRFQEALTADKGHSIKAVLVTHNE TATGVRSDIAAVRGAMNSAKHPALLMVDCVSSLGSMPFEMDDWGVDIAVSGSQKGFMLNTGMAILAVSP KALAMMETAKLPRTFFDFRDMMGANAKGGFPYTPPLQLIYGMAESLNMLFEEGLENVYARHARIAEGVR RAVDAWGLKLVAQTPDLYSDTVSAVFVPEGFDSNRLTERVFGTYGMSFGVGLGEMNGRAFRIGHLGSLT ESMMLSGLATLEMAMVDLNYPVKLGSGVIAAQEYYRSTAKPVLAEKAA |
| 485 | MSDQNPIFIPGPTNIPDRLRFAMNVQSSDHRSPGFVETLSPLLQDCKKVFNTQSGEVILFPASGTGGWEA AICNTLSPGDKVLIARYGMFSRRWIEMCQRHGLDVQIIECPWGSGAPANEFKRALSADTQHKIKAVLVVH NETATGVTSDIDAVRQAMDSCFHPALLLVDCVSSLASMPFEMDNWGVDIAVSGSQKGFMLITGMAILAVS QKALVAMETAKLSCAFFDFRAMMTANAQGGFPYTPPLQLIYGLKESLKMLFEEGLDNVYARHFRLAEGV RQAAHAWGMALCAQSPDLYSNTVTAIYVPEGLNSNELTDHTFAKYGVSFGIGLGEMHGKAFRIGHLGSLT DSMVLSGLATIEMAMADLDYPIELGTGVRAAQNHFRATIA |
| 486 | MYTQNPVFIPGPTNMPEVLRRATDLPTIDHRSAAFADILQPALAGVRKVVKSETAEVVVFPATGSGGWEA TITNLLSPGDRVLAARCGVFSHRWIDMCQRHGLQVDTVHASWKQPLPLAEYEKRLLADKEHAIKAVLVTH NETGTGVRSDVGAVRRLLDEARHPALLLVDGVSSIASMDFRMDEWKVDAAITGSQKGFMLPVGLAILALS AKAMQATQSATLHRGFFDIREMAKTYPSSGYPYTPSIGLLNGLKVSTELLLGEGLDNVFKRHARIASGVRA AVSAWGLSLYAQEKSSFSDTVSAIETPEGFDATSIVTHAAQKYGVAFGAGLADVAGRVFRIGHLGSMSDV MALSGIATAEMAMVDLGLPIRLGSGVAAAQEIYRNTTASPVRNAA |
| 487 | MSFQNPVFIPGPTNMPEALRKAVDMPTLDHRSPLFGQILHPALAGVKKILKSETAEIFVFPSTGTGGWETA ITNTLNAGDKILAARNGMFSHRWIDMCQRHGLDVQVVETPWGAGIPADRYEEILTADKGHEIKVVLATHN ETATGVKSDIAAIRRALDAAGHPALLFVDGVSSIASMDFRMDEWGVDIAVTGSQKGFMLPPGLAIVGFSPK AMKAADTATLPRTFFDIKDMAAGYANSAYPYTPSIGLLNGLNMACGMLLDEGLENVFARHHRIAEGVRAA VRAWGLELCAVSPDIYSDSVSAIRTPDGFDANKFVSLAAEKYGVAFGTGLGEVAGKVFRIGHLGSLTDVM ALSGIATAEMVMADLGLNIQLGSGVAAAQDYYRGNSANSAKAAA |
| 488 | MSDQNPVFIPGPTNIPDRLRAAMHVQTRDHRAPDFVETFAPVLEDTKKVFGTSGRVITFPASGTGGWE AALCNTLSPGDKVLVARYGMFSHRWIDMCERHGLDVQLIECPWGTGAPADKFEAALSADKSHSIKAVLV THNETATGVKSDVAAVRGAMDAAAHPALLFVDCVSSLASMPFEMDSWGVDIAVSGSQKGFMLATGMAIL GVSDKALAAMEAATLPRTFFDFKDMMGANASGGFPYTPPLQLIYGMRESLKMLLEEGLDNVYARHTRLA EGVRRAVGAWGLELVAQTPDLYSDTVSAIYVPSGFDSNALTDQAFNQYGVSFGVGLGEMNGKAFRIGHL GSLTDVMVLSGLATIEMAMADLDYPIELGSGVAAAQEHFRSKTGAAIKSAA |
| 489 | MSFQNPVFIPGPTNMPEAIRQACYMPTIDHRSPMFGKILHPVLDGVRRVLKSKTAKIFIFPSTGTGGWETA LSNCLNAGDKVLAARNGMFSHRWIDMCLRHGLDVQVVETPWGHGLPAAEYEDILKADKNHDIKVVLATH NETATGVKSDIAAVRKALEAANHPAMLFVDGVSSIGSMDFRMDEWGVDVAVTGSQKGFMLPAGLAIVGF SDRAMQATKTSTLPRTFFDVHDMQKGYDNNAFPYTPPVGLMNGLKLALEMIEEEGLENVFTRHRRIATG VRLAVKAWGLELCAVSPDVYSDTVSAIKTPDGFNATDIVTRAADKYGMAFGVGLGEVAGNVFRIGHLGML TDAMMLSGLGVAEMVMVDLGLDVKLGSGVAAAQQFYRHGI |
| 490 | MHMQNPVFIPGPTNIPEVLRKAVDMPTLDHRSSLFGDILAPALAGSKQVLKTETADCFILPATGTGGWETA ICNTLSPGDAVLAARHGMFSHRWIDMCRRHQLSVEKVDGRWGTAAPADRFEEILAGDKAHRIKAVLVTH NETATGVRSNIREIRTAIDRARHPAFLFVDGVSSIGSMDFRMDEWGVDVAVTGSQKGFMLPAGLAIVAFS QRAMEATARAKLPRAFFDIRDMAKSYASGGYPYTPTVGLLNGLKVSTELLLAEGLDSVFARHRRIATGVR AAVAAWGFRLCAEEPSIYSETVSAIRTPEGFDATSIVTHASRKYDVAFGVGLGDVAGKVFRIGHIGSLTDV MALSGIAAAEMAMVDLGLKVDLGSGVSAAQDVYRMAHDTEALAAA |
| 491 | MSFQNPVFIPGPTNIPEAIRKACDMPTIDHRSPIFGQILQPAREGVRAVLISQDAEIIIIPASGTGGWETALTN TLSPGDTVLAARNGMFSQRWIEMCRRLGLAVEIVDTPWGNGIPADRYEEALRADKHHKIKAVLATHNETA TGVASDIAAVRRAMDAANHPALLFVDGVSSIGSIDFRFDDWGVDVAVTGSQKGFMLPAGLAILGFSPKAL DAGKHATMPRAYFDVADMQASYAKNSYPYTPSVGLLNGLLLSTQMLLAEGLENVFARHTRIATGVRAAV QAWGLKLCAASPDLYSDTVSAIMTPPGFNATDIVTHAAETYGVAFGVGLGEVAGKLFRIGHLGSMTDVMA LSGIATAEMCMVDLGLDITLGSGVAAAQDYYRGSTGHVMKDAA |

FIG. 12AQ

| 492 | MSFQNPVFIPGPTNMPEALRKAVDMPTLDHRSPLFGQILHPALAGVKKILKSETAEIFVFPSTGTGGWETA<br>ITNTLNSGDKILAARNGMFSHRWIDMCQRHGLDVQVVETPWGEGLPADRYEEILTADTSHQIKAVLATHN<br>ETATGVKSDIAAVRRALDAAGHPALLFVDGVSSIASMDFRMDEWGVDIAVTGSQKGFMLPPGLAIVGFSP<br>KAMKAAETATLPRTFFDIKDMANGYANSAYPYTPSVGLLNGLNMACGMLLDEGLENVFARHHRIAEGVR<br>AAVRAWGLELCAVSPDVYSDSVSAIRTPDGFDANKFVSLAAEKYGVAFGTGLGEVAGKVFRIGHLGSLTD<br>VMALSGIATAEMVMADLGLNIQLGSGVAAAQDYYRGNTASSTKAAA |
|---|---|
| 493 | MSTHNPVFIPGPTNIPEEIRKACDIPTLDHRSPAFARLFKPAVAGIRRVLAMDQGEIILPSTGTGGWEAAIT<br>NTLSSGDKVLAPRFGMFSHRWIDLCQRHGLDVQIIETPWGQGAPLAEIEAALRADSAHEIKAVLATHNETA<br>TGVRSDIAGIRRALDAAGHPALLLVDGVSSIGSMPFDMAGWGVDIAVAGSQKGFMLPAGLAILGVSPKAL<br>NAMEKATLPRTFFDFRDMLAAYAAGGYPYTPAVGLIAGLAKAIEMLEDEGLENVYARHHRLAEATRRAVA<br>AWGMRPCAATPELYSDTVTAVVVPEGCNGTDLVQLAASKYGVAFGVGLGEVAGKVFRIGHLGMLSDVM<br>LLSGLATAEMCMADLGWDVQLGSGVAAAQEYLRNSAGVALARAA |
| 494 | MTDQNPVFIPGPTNMPDRLRRAIQIQTRDHRAPDFVDTFAPVLEDTKKVFGSTEGKIITFPASGTGGWEA<br>AVTNTLSPGDKILVGRYGVFSNKWIDLCQRHGLDVQIVETPWGEGVPADKFAEILSADTAHEIKAVLTTHN<br>ETATGVRSDIAAVRRALDGADHPAMLFVDCVSSLASMPFEFDAWGVDIAVSGSQKGFMLPTGMAILCVS<br>PKALAAIETAGLSRTFFDFRDMMKANATGGFPYTPPLQLIYGLRESLDMLFEEGLENVFARHFRLAEGVR<br>RAVDAWGMKLVAKSPDLYSDTVSAVYVPEGFDSNALTDHAYRAYKVSFGVGLGQLDGKAFRIGHLGSLT<br>DVMVLSGLATIEMAMADLNYPITLGSGVAAAQEYYRTSRVAALKSAA |
| 495 | MTSQNPIFIPGPTNIPEEMRKAVDMPTIDHRSPVFGRMLHPALEGVKKVLKTTQAQVFLFPSTGTGGWET<br>AITNTLSPGDKVLAARNGMFSHRWIDMCQRHGLDVTFVETPWGEGVPADRFEEILTADKGHEIRVVLATH<br>NETATGVKSDIAAVRRALDAAKHPALLFVDGVSSIGSMDFRMDEWGVDIAVTGSQKGFMLPPGLAIVGFS<br>PKAMEAVETARLPRTFFDIRDMATGYARNGYPYTPPVGLINGLNASCERILAEGLENVFARHHRIASGVRA<br>AVDAWGLKLCAVRPELYSDSVSAIRVPEGFDANLIVSHALETYDMAFGTGLGQVAGKVFRIGHLGSLTDA<br>MALSGIATAEMVMADLGLPIQLGSGVAAAQEHYRQTTAAAQKKAA |
| 496 | MSNQNPVFIPGPTNIPDRLRLAMHVQTQDHRAPDFVDTFMPVLEGTKKVFGTTTGQIVTFPASGTGGWE<br>AAITNTLSPGDKVLVARYGVFSHRWIDLCERHGLDVQVIECPWGSGAPADQFQTALADDTAHEIRAVLVT<br>HNETATGVRSDISAVRRAMDVTDHPAMLFVDCVSSLASMPFAFDDWGVDIAVSGSQKGFMLATGMAILC<br>VSPKAQEAMASAKLPRTFFDFGDMMAANASGGFPYTPPLQLIYGMRESLNMLFEEGLENVYARHFRLAE<br>GVRRAVDAWGLKLVAQSPDLYSDTVSAIYVPDGFDSNALTDHAFNTYDVSFGVGLGQMNGRAFRIGHLG<br>SLTDVMVLSGLGAIEMAMADLDYPIVLGSGVAAAQDYYRSGPSDSAKAAA |
| 497 | MSMQNPVFIPGPTNIPEALRRACDMPTIDHRSPLFGQILHPARTGVRRVLKSDSAEIFLFPSTGTGGWETA<br>LSNTLSPGDGVLVARNGMFSARWIDMCERHGLEMTIIETPWGEGIPADRFEEALTADTGHRIKAVLATHN<br>ETATGVRSDIAAVRRAMDAAGHPAMLFVDGVSSIASMDFRFDEWGVDVAVTGSQKGFMLPPGLAILGFS<br>QRALEARATATLPRTFFDTRDMERGYAANGYPYTPAVGLMNGLNIACDMLLSEGLEAVFARHHRIAEGV<br>RAAVAAWGLKLCAVRPELQSDTVSAIRTPEGFDANRIVAHAAEAYGVAFGTGLGAVAGKVFRIGHLGSLT<br>DVMALSGIATAEMVMADLGLPVTLGSGTAAAQEVYRATRATALKDAA |
| 498 | MSFQNPVFIPGPTNIPESLRKACDMPTIDHRSPLFGQILHPAREGVRKVLKSDAAEVFIFPSTGTGGWETA<br>LSNTLSPGDTVLAARNGMFSHRWIDMCQRHGLSVEIVETPWGEGLPAHRYAEILAADKQHRIKAVLATHN<br>ETATGVRSDIAAVRRALDDAGHPALLFVDGVSSIASMDFRFDEWGVDCAVAGSQKGFMLPPGLAIVGFS<br>DKAMAATQTARLPRTFFDVQDMAKGYANNAYPYTPAVGLLNGLNEACRMLLDEGLENVFARHHRIAEGV<br>RCAVRAWGLELCAASPEVYSDTVSAIRTPDGFNATDIVSHAAQTYGVAFGTGLGEVAGKVFRIGHLGSLT<br>DVMTLSGLATAEMCMKDLGLDITLGSGVAAAQEFYRATPALARKAAA |
| 499 | MSFQNPVFIPGPTNIPESLRKACDMPTIDHRSPLFGQILHPAREGVRNVLKSDSAEVFIFPSTGTGGWETA<br>LTNTLSAGDKVLSARNGMFSHRWIDMCQRHGLVVQIVETPWGEGVPADRYEEILTADKNHQIKVVLATH<br>NETATGVKSDIAAVRRALDAAGHPALLFVDGVSSIGSMDFRFDEWGVDVAVTGSQKGFMLPAGLGIVGF<br>SAKAMAATKTGTLPRTFFDVHDMAKGYANNAYPYTPAVGLLNGLNVACGMLLNEGLENVFARHTRIASG<br>VRAAVSAWGLELCAATPSVYSDTVSAIRTPEGFNATDIVTHAADRYGVAFGVGLGEVAGKVFRIGHLGSL<br>TDVMMLSGIATAEMCMADLGLDITLGSGVAAAQDYYRSHGVAAQKDAA |
| 500 | MSTQNPIFIPGPTNIPERLRRAVDYPSIDHRSPAFAEMLKPAQDGVRRILRSKQAEIILFPSTGTGAWEAAIT<br>NTLSPGDKVLAARYGMFSHRWIDLCRRHGLEVEVIETPWGEGAPAEAFEEALKADAGHAIKAILVCHNET<br>ATGVVSDIAAVRRAIDAARHPALLYVDGVSSIASMDFRMDDWGVDIAITGSQKGFMLPAGLAILGIGPKAIQ<br>AVASAQCPRCFFDFRDMLKSNAGGGYPYTPPVNLIRGLSVSIAMLEEEGLPRVLARHHRIAEGVRRAVAA<br>WGLSLCAQRPELYSDTVSAVVVPDGFDATRIVTHAAEKYGVAFGVGLGEVAGKLFRIGHLGSMTDVMAL<br>SGIATAEMVMADLGLPVTLGSGVAAAQEYYRTSRENAGSARAAA |
| 501 | MYGQNPVFIPGPTNMPEILRKAADMPTMDHRSSMFGEILHPALAGVKQVLKSETASVFIFPATGSGGWET<br>AITNTLSPGDRVLAGRHGMFSHKWIDMCRRYQLTVDAIESSWHDGVPLAQYEELLNGDKAHEIKAVLVTH<br>NETATGVKSDVAAVRRLLNAANHPALLLVDGVSSIASMDFRMDEWGVDVAVTGSQKGFMLPVGLAITAF<br>SAKAMAALETAKLPRAFFDVRDMAKGYSTNGYPYTPSVGLLNGLKVSTELLLQEGLENVFARHRRIASGV<br>RAAVRAWRLELYAAREELYSETVTAVQTPAGFDASRFVTHAATKYDVAFGAGLGDVAGKVFRIGHVGSM<br>TDVMALSGIATAEMVMVDLGLNIKLGSGVAAAQAIYRNSQSSASYMVA |

FIG. 12AR

| | |
|---|---|
| 502 | VSTQNPIFIPGPTNIPEVLRKAVDMPTIDHRSPMFGKILHPALEGVKKVLKSTQAQVFVFPSTGTGGWETAI TNTLSEGDAVLATRNGMFSHRWIDMCQRHGLDVQIVDQSWGEGIPTDRFEEILTADTAHRIKAVLATHNE TATGVRSDIAAIRRALDRAGHPAMLFVDGVSSIACYDFRMDEWGVDVAVTGSQKGFMLPPGLAIVGFSPK AMTAVEGASLPRTFFDIRDMARGYAANGFPYTPPVGLLNGLKVATDMLLDEGLENVFARHHRIAEGVRQ AVAAWGMTLCAARPALYSDSVSAIRTPDGFDANRIVSHALKTYGVAFGTGLGDVAGKVFRIGHLGMLTDV MALSGLATAEMVMVDLGLPVTLGSGVAAAQAHYRHSAGQACRQAA |
| 503 | MSNQNPVFIPGPTNIPDRLRLAMQVQTQDHRAPDFVETFGPVLEDTKQVFGTTKGQVVTFPASGTGGW EAAITNTLSPGDKVLVARYGVFSHRWIDLCERHGLNVQIVECPWGTGAPADRFEAILSADKAHEIRAVLVT HNETATGVLSDIGAVRRAMNAARHPAMLFVDCVSSLASMPFRFDQWGVDIAVSGSQKGFMLATGMAILC VSPKALAAMETARLPRTFFDFRDMMAANASGGFPYTPPLQLIYGMRESLKMLFEEGLDTVYARHHRLAE GVRRAVNAWGLKLVAQSPELYSDTVSAIYVPEGFDSNKLTDHAFDKYGVSFGIGLGEMNGKAFRIGHLG SLTDVMVLSGLATIEMAMADLNYPVNLGSGVAAAQEYYRAGSSSDAKAAA |
| 504 | MTDQNPVFIPGPTNMPDRLRRAIQIQTRDHRAPDFVDTFAPVLEDTKKVFGSTEGKIITFPASGTGGWEA AVTNTLSPGDKILVGRYGVFSNKWIDLCQRHGLDVQIVETPWGEGVPADKFAEILSADTAHEIKAVLTTHN ETATGVRSDIAAVRRALDGADHPAMLFVDCVSSLASMPFEFDAWGVDIAVSGSQKGFMLPTGMAILCVS PKALAAIETAGLSRTFFDFRDMMKANATGGFPYTPPLQLIYGLRESLDMLFEEGLENVFARHFRLAEGVR RAVDAWGMKLVAKSPDLYSDTVSAVYVPEGFDSNALTDHAYRAYKVSFGVGLGQLDGKAFRIGHLGSLT DVMVLSGLATIEMAMADLNYPITLGSGVAAAQEYYRTSRVAALKSAA |
| 505 | MTFQNPVFIPGPTNMPEHIRLACHMPTIDHRSPVFGKILHPCLEGVQRILKSTSAKVFIFPSTGTGGWEVA LSNTLSKDGKVLAARNGMFSHRWIDMCQRHGLDVQIVETPWGHGLPADKYEEILRADKSHSIKVVLATHN ETATGVKSDIAAVRRALDAANHPAMLFVDGVSSIGSMDFRMDEWGVDVAVTGSQKGFMLPAGLAIIGFST KAMAAIDAATLPRTFFDVRDMAKGYANNAFPYTPPVGLMNGLKAAIEMIEGEGLENVFARHTRIATGVRH AVDAWGLKLCAAGPDVYSDTVSAICTPEGFNATDIVTVAARDYDMAFGVGLGEVAGKVFRIGHLGSLTDA MMLSGLATVEMVMVDLGLDIKLGSGVAAAQAHYRHGSNKSKRMAAE |
| 506 | MSFQNPVFIPGPTNMPEHIRQACYMPTIDHRSPMFGKMLHPILDGVRRVMKSQSAHIFIFPSTGTGGWET ALTNCLSAGDKVLAARNGMFSHRWIDMCQRHGLDVQIVETAWGDGLPADKYEEILKADTNREIKVVLATH NETATGVKSDIGAVRKALDAAEHPALLFVDGVSSIGSMDFRFDDWGVDVAVTGSQKGFMLPAGLAIVGF SDKAMKATETATLPRTFFDVKDMQKGYDNNAFPYTPPVGLMRGLEASLKLIEDEGLENVLARHTRIATGV RHAVDAWGLRLCANSPEVYSDSVSAIRTPEGFNATDIVTRSADKYGMAFGVGLGEVAGKVFRIGHLGLLT DAMMLSGLGVAEMVMVDLGLDIKLGSGVAAAQEFYRHGS |
| 507 | MTSQNPIFIPGPTNIPEEMRKAVDMPTIDHRSPVFGRMLHPALEGVKKVLKSTQAQVFLFPSTGTGGWET AITNTLSPGDKVLAARNGMFSHRWIDMCQRHGLDVTFVETPWGEGIPADRFEEILTADKGHEIRAVLATH NETATGVKSDIAAVRRALDAAKHPAMLFVDGVSSIGSMDFRMDEWGVDIAVTGSQKGFMLPPGLAILGFS PKAMAAVESARLPRTFFDIGDMGEGYARNGYPYTPPVGLINGLNASCERILAEGLENVFARHHRIAGGVR AAVGAWGLKLCAARPELYSDSVSAIRVPEGFDANLIVSHALDTYDMAFGTGLGQVAGKVFRIGHLGSLTD AMALAGLATAEMVMADLGLPIRLGSGVAAAQDHYRQTTAAALKKAA |
| 508 | MHASNPIFLPGPTNLPEPLRRACDIPTMDHRSAAFGPILAAAKDGVARILGLSGGEVALFPATGTGGWEA AVTNALRPGDKVLAARHGMFSRKWIDLCQRHGLEVEIVERPWGEGVPVEEFAAALAADGGHQIRAVLVT HNETATGVTSDVAAVRAAMDATGHPALLMVDGVSSIGSIEFRMDDWGVDLAVAGSQKGFMLPAGLAIIGI SAKARQAMETAGLPRCFFDIRDMADGNYPYTPPVGLINGLAVSTGLLLEEGMENVRARHHRIAEGVRRA VAAWDMTTCAAAPELCSDTVTAIVTPEGFDAGRIVRHAAEAYGVAFGGGLGEVAGKVFRIGHLGLMSDV MALSGIATAEMAMVDLGLPVRLGSGVAAAQEHYRNSRTAPVQAAA |
| 509 | MSFQNPVFIPGPTNMPESLRKAVDMPTLDHRSPLFGQILHPALEGVKKVLKSETAKVFIFPSTGTGGWET ALTNTLSAGDKVLAARNGMFSHRWIDMCQRHGLDVQIVETPWGAGLPADKYADILKVDADHEIKVVLATH NETATGVRSDIAAVRKALDAANHPAMLFVDGVSSIASMDFRMDEWGVDIAVTGSQKGFMLPAGLAIVGFS PKAMAALETATLPRTFFDVRDMGNGYANNAYPYTPAVGLLNGLNEACKMLLDEGLENVFARHHRIAEGV RQAVSAWGLELCAVSKDVQSDTVSAIRTPEGFNATDIVTHAANKYGVAFGVGLGEVAGKVFRIGHLGSLT DVMTLSGLATAEMCMVDLGLDIKLGSGVAAAQEYYRANQLAMSKAA |
| 510 | MSFQNPVFIPGPTNMPEALRKAVDMPTLDHRSPLFGQILHPALAGVKKVLKSENAEIFVFPSTGTGGWET AITNTLSAGDKVLAARNGMFSHRWIDMCQRHGLEVQVVETPWGEGLPADRYEEILTADTAHEIKVVLATH NETATGVKSDIAAVRRVLDAAGHPALLFVDGVSSIASMDFRMDEWGVDIAVTGSQKGFMLPPGLAIVGFS PKAMQAVKTASLPRTFFDIKDMALGYSNSAYPYTPSVGLLNGLNMACGMLLEEGLENVFARHHRIAEGV RSAVRAWGLELCAVSPEVYSDSVSAIRTPDGFDANKFVSLAAEKYGVAFGTGLGEVAGKVFRIGHLGSLT DVMALSGIATAEMVMADLGLNIPLGSGVAAAQDYYRGNTAASTKAAA |
| 511 | MSDQNPVFIPGPTNIPDRLRRAMQVQTQDHRSPAFVNTLAPVLEGCKTVFGTTVGQIITFPASGTGGWEA AITNTLSPGDKVLVARYGMFSHRWIDMCQRHGLSVEIIECAWGSGAPADRFEEALKADNGHAIKAVLVTH NETATGVRSDIAAVRRAIQEADHPALLMVDCVSSLASMPFEMDKWGVDIAVSGSQKGFMLNTGMAILAV SPKALATMERAQLPRTFFDFRDMMSANGKGGFPYTPPLQLIYGMAESLDMLFEEGLDNVYARHTRLAEG VRRAVSGWGLRLVAQSPDLYSDTVSAVYVPEGFDSNALTEHAFANYGVSFGVGLGEMNGRAFRIGHLG SLTATMVLSGLATLEMAMADLKYPVRLGSGVIAAQEYYRATAKSTLTERAA |

FIG. 12AS

| | |
|---|---|
| 51 | MSFQNPVFIPGPTNIPENLRKACDMPTIDHRSPLFGQILHPARAGVQKVLKSTSAEVFIFPSTGTGGWETA |
| | LTNTLSAGDTVLAARNGMFSQRWIDMCQRHGLNVNVVETPWGQGVPADRYAEILAADTGHQIKAVLATH |
| 2 | NETATGVRSNIAAVRQALDDAGHPAMLFVDGVSSIGSMEFRFDDWGVDVAVTGSQKGFMLPAGLIVGF |
| | SAKAMEATKSAKLPRTFFDVHDMAKGYANSAYPYTPAVGLLNGLNTACGMLLDEGLANVFARHHRIAEG |
| | VRAAVGAWGLDLCAASPDLYSDTVSAIRTPEGFNATSIVTHAAEVYGVAFGVGLGEVAGKVFRIGHLGSL |
| | TDVMMLSGIATAEMCMADLGLDITLGSGVAAAQDYYRANRAERQQDAA |
| 51 | MSNQNPVFIPGPTNIPDRLRLAMQVQTQDHRAPDFVETFSPVLEDTKKVFGTKEGKIITFPASGTGGWEA |
| | SVTNTLSPGDSVLVARYGMFSHRWIDLCQRHGLDVRIIECPWGSGAPADKFAEALAADKEHKIRAVLVTH |
| 3 | NETATGVRSDIGAVRGAMDASDHPAMLFVDCVSSLASMPFEFDGWGVDIAVSGSQKGFMLATGMAILCV |
| | SPKALAAMETAQLPRTFFDFRDMMNANASGGFPYTPPLQLIYGMRESLKMLFEEGLNNVYARHFRLAEG |
| | VRKATAAWGLELVAQSPELYSDTVSAIYVPDGFDSNALTDHAFNAYGVSFGIGLGEMNGKAFRIGHLGSL |
| | TDVMVLSGLATIEMAMADLDYPIKLGSGVAAAQEYFRTSSATPMQSAA |
| 51 | MSFQNPVFIPGPTNMPEAVRQACYMPTIDHRSPTFGKILHPCLDGVRKVLKSDSAHIFIFPSTGTGGWET |
| | ALTNTLSKGDKVLAARNGMFSHRWIDMCQRHGLDMQIVESPWGNGLPADHYEEILRADTGHKIKVVLAT |
| 4 | HNETATGVKSDIAAVRRALDAAGHPAMLFVDGVSSIASMDFRFDEWGVDVAVTGSQKGFMLPAGLAIVG |
| | FSDRAVAASKTAELPRTFFDIKDMQNGYNASAFPYTPPVGLMNGLKLSLDMLLSEGLENVFARHHRIAEG |
| | VRAAVRAWGLELCATSPDVYSDTVSAIRTPEGFNATDIVTHAADTFGVAFGVGLGEVAGRVFRIGHLGSL |
| | TDVMTLSGLAAEMCMADLGLNIPLGSGVAAAQEYYRSHPSAALKSAA |
| 51 | MSLQNPIFIPGPTNIPDRLRRAMNVPTQDHRAPDFSDTFLPVLADCKKVFGTQDGEIILFTSSGTGGWEAA |
| | ISNTLSPGDKVLIARYGMFSHRWIDMCQRHGLDVQIVECAWGTGAPADQFQAILSEDTAHEIKAVMVTHN |
| 5 | ETATGVLSDIGAVRKAMDSSDHPALLFVDGVSSIASVPFEMDDWGVDIAVAGSQKGFMLATGMAILGVSQ |
| | KALSHMDEAKLPRTYFDFRDMLKANANGGFPYTPPLNLIYGMRASLDMLFEEGLENVYARHHRLAEGVR |
| | QAVSAWGFKLCAASPDLYSETVSAIYVPEGFDSNELTDHAFNKYGISFGIGLGEMHGKAFRIGHLGSLTEV |
| | MVLAGLATIEMAMVDLDYPIKLGQGVAAAQEYYRNN |
| 51 | MTAHQAFAQNPVFIPGPTNMPEALRKACDVPTLDHRSPAFARMLAPALAGVKRVMGMESGEVFLLPATG |
| | TGGWEAAIANTLSPGDRVLAARYGVFSARWIDLCQRFGLEVEVLDTPWGEGLPLERIEAALRADRTGRIK |
| 6 | TVLATHNETATGVRSDIAGLRRAMDRAGHEALMMVDGVSSIASMPFDFSGWGVDIAVTGSQKGFMLPP |
| | GLAILGLSDRALAAMENARLPRTYFDLKDMRRSMAAGGYPYTPPVGLIAGLAASVAMLEDEGLAAVHAR |
| | HYRLAEGVRRAVAGWGLSTCAAGPALASDTVTAVLAPEGCDANAFVARAAGTYGMAFGTGLGQLAGKA |
| | FRIGHLGMLSDPLMLAGLATAEMVMADLGWPVRLGSGVVAAQDFYRGALPLAAAA |
| 51 | MHALNPIFLPGPTNLPEALRRACDIPTMDHRSAAFGPILASAMAGVKQVLGLSEGEVAIFPATGTGGWEA |
| | AVTNTLRPGDKVLAARHGMFSRKWIDLCQRHGLDVEIVERPWGEGVPVEAFAAALAADTGHRIRAVLVT |
| 7 | HNETATGVTSDVAAVRAAMTAAGHPALLMVDGVSSIGSIDFRMDAWGVDLAVTGSQKGFMLPAGLAIVGI |
| | GPKALAAMETSGLPRCFFDIRDMLGGNYPYTPPVGLINGLAVSTGLLLEEGMEAVRARHHRIAEGVRRAV |
| | AAWGMTTCAARPELCSDTVTAIVTPDGVDAGRIVRHAAEAYGVAFGGGLGEVADKVFRIGHLGLMSDVM |
| | ALSGIATAEMAMTDLGLPVRLGSGVAAAQEHYRNSRTAPVRAAA |
| 51 | MYTQNPVFIPGPTNMPEVLRRATDLPTIDHRSAAFADILQPALAGVRKVVKSENAEIVVFPATGSGGWEA |
| | TITNLLSPGDKVLAARCGMFSHRWIDMCQRHGLQVDTVHSSWQQPLPLAEYEKRLFADKGHDIKAVLVT |
| 8 | HNETATGVKSDVGAVRRLLDDAKHPALLLVDGVSSIASMDFRMDEWKVDAAITGSQKGFMLPVGLAILAL |
| | SPKAMQAAQSAKLHRAYFDIREMAKTYPSSGYPYTPSVGLLNGLKMSTELLLGEGLDNVFKRHARIASGV |
| | RAAVSAWGLRLYAQEESSFSDTVSAVETPDGFDATSIVTHAAQKYAVAFGAGLGDVAGRVFRIGHLGSM |
| | SDVMALSGIATAEMAMADLGLPIRLGSGVAAAQEIYRNSAASAIRNAA |
| 51 | MSFQNPVFIPGPTNMPEALRRACDMPTLDHRSPLFGQILQPALAGVKKVLKTETAEVFLFPSTGTGGWET |
| | AITNCLSPGDKILAARNGMFSHRWIDMCQRHGLKVEVVEAAWGTGLPADRYEEILAADTNHVIKAVLATH |
| 9 | NETATGVKSDIAAVRRALNAAKHPALLFVDGVSSIASMDFRMDEWGVDAAVTGSQKGFMLPPGLAIIALS |
| | PKAQAAVESARLPRTFFDVRDMMKAYANNAYPYTPAVGLMNGLKQSCDMLLAEGLDNVFARHHRIAEG |
| | VRAAVRAWGLELCAQTLDVYSDSVSAIRTPEGFNATGIVTHAAAKYGVAFGVGLGEVAGKVFRIGHLGSL |
| | TDVMMLSGLATAEMVMADLGLDIKLGSGVAAAQEVYRSDSAIASKEAA |
| 52 | MSFQNPVFIPGPTNIPESLRKACDMPTIDHRSPLFGQILHPARDGVRKVLKSETAEVFIFPSSGTGGWETA |
| | LSNTLSAGDTVLAARNGMFSHRWIDMCQRHGLEVQIVETPWGAGLPADRYEEILSADKAHKIKAVLATHN |
| 0 | ETATGVKSDIAAVRRALDAAGHPALLFVDGVSSIASMDFRMDEWGVDVAVTGSQKGFMLSAGLAIVGFS |
| | PKAMEATKSAQLPRTFFDVHDMAKGYANNAYPYTPAVGLMNGLNESCKMLLAEGLENVFARHHRVAEG |
| | VRAAVGAWGLELCAATPEVYSDTVSAIRTPEGFNATDIVTHAADKYGVAFGLGLGEVAGKVFRIGHLGSL |
| | TDVMALSGIATAEMCMVDLGLDIQLGSGVAAAQEYYRGNAVSAQQDAA |
| 52 | MSFQNPVFIPGPTNMPEAIRQACYMPTIDHRSPVFGRILHPCLDGVRRVLKSESAHIFIFPSTGTGGWETA |
| | LTNTLSPGDTVLAARNGMFSHRWIDMCQRHGLTVQVIETPWGEGIPAGKMEEALRADKDRAIKVVLATH |
| 1 | NETATGVKSDIAAVRRALDAAGHPAMLFVDGVSSIASMDFRFDEWGVDVAVTGSQKGFMLPAGLAIVGF |
| | SEKAMNAVETARLPRTFFDVRDMARGYANNAFPYTPPVGLMNGLKLSLQMIEDEGLENVFARHRRIATG |
| | VRRAVDAWGLELCAVSPDVQSDTVSAIRTPEGFNATDIVTVAARDYGMAFGVGLGEVAGKVFRIGHLGS |
| | LTDAMMLSGLGTAEMVMVDLGLPIKLGSGVAAAQDVYRRGGEARKAAA |

FIG. 12AT

| | |
|---|---|
| 522 | MSFQNPVFIPGPTNMPESIRKACDMPTIDHRSPLFGQILHPARANVQKVLKSDSAEVFIFPSTGTGGWET AITNTLSAGDTVLAARNGMFSHRWIDMCQRHGLDVQIVETPWGHGLPADRYADALQADKAHKIKAVLAT HNETATGVKSDIAAVRAALDAADHPALLFVDGVSSIGSMDFRFDDWGVDIAVTGSQKGFMLPAGLAILGF SAKARAATKTAGLPRTFFDVNDMAKGYDNSAFPYTPPVGLMNGLLLASDMLLREGLDNVFARHTRIASGI RAAVHAWGLDLCAATPDLYSDTVSAINTPAGFNATQIVNHAASAYGVAFGTGLGEVAGKVFRIGHLGSMT DVMALSGIATAEMCMVDLGLDIKLGSGVAAAQEHYRRTTGQALKDAA |
| 523 | MYTQNPVFIPGPTNMPEVLRRAADLPTIDHRSAAFADILQPALAGVRKVVKSEDAEIIVFPATGSGGWEAA ITNLLSPGDKVLAARHGMFSHRWIDMCQRHGLQMDVAHSSWKHPLPLAEYEKRLVADKGHDIKAVLVTH NETATGVKSDVGAVRRLLDEAGHPALLLVDGVSSIASMDFRMDQWKVDAAITGSQKGFMLPVGLAILALS AKAMQAVQSAKLRRGFFDIREMAKSYPASGYPYTPSVGLLNGLKVSTELLLGEGLDNVFKRHARIASGVR AAVSAWGLRLYAQEASSFSDTVSAVETPEGFDATSIVTLAAQKYGVAFGAGLGDVAGRVFRIGHLGSMS DVMALSGIATAEMAMADLGLPIRLGSGVAAAQEIYRNTAASPVRKAA |
| 524 | MFAQNPVFIPGPTNMPEVLRRAADMPTLDHRSPYFAQILHPALAGVKKVLKSETAEVFIFPSTATGGWET ALSNTLSVGDAVLASRYGMFSHRWIDMARRHGLDVRVIEAPWGQGLPADRFAEALSADKAHRIKAVLVT HNETATGVKSDVAAVRRALDATGHPALLLVDGVSSIASMDFRMDEWGVDVAVTGSQKGFMLPAGLAITA FSPKAMDATATATLPRTYFDIRDMAKGYANGAYPYTPSVGLLNGLKLSTELLLAEGLDAVFARHRRIADGI RAAVSAWGLELCAARPELYSDTVSAIRTPEGFDATQIVTHAARQYDVAFGVGLGEVAGKVFRIGHLGSLT DVMALSGIAAAEMAMADCGLRIELGSGVAAAQAVYRGAAGTRLRAAA |
| 525 | MYMQNPVFIPGPTNMPEILRKAADMPTLDHRSPLFGQILRPALAGVKKILKTEAASVYVFPSTGTGGWET AITNTLSPGDRVLAARYGMFSQRWIDMCQRHGLKVDIIEAAWGGGAPAARYEEILAADTAHEIKAVLVTHN ETATGVKSDIAAVRRAIDAARHPALLFVDGVSSIASMDFRMDEWLVDIAVTGSQKGFMLPAGLAITAFSPK ALAAVETAKLPRTFFDIGDMARSYANNAYPYTPAVGLLNGLKLSTELLLAEGLENVFARHRRIASGIRAAV RAWGLELCAMSEDLYSDTVSAIRTPEGFDATSIVAHAAKTYDVAFGVGLGEVAGKVFRIGHLGSLTDVMA LSGIATAEMVMVDLGLDIKLGSGVAAAQDYYRDGRASKVRAAA |
| 526 | MYMQNPVFIPGPTNMPEVLRRAADMPTLDHRSPRFAEILHPALAGVRKVIKGASSEVFVFPSTGTGGWE TAITNTLSPGDTVLAARFGMFSHRWIDMCRRHGLNVELVEEAWGNALPIEAYEARLRADRQHRIKAVLAT HNETATGVRSDIAAVRRALDAANHPAMLFVDGVSSIASMDFRMDEWGVDIAVTGSQKGFMLPVGLAIVA CSPRAMDVMADAKLPRTFFDIADMRARYADGAYPYTPSVGLLNGLKLATEMLLTEGLDNVFARHRRIAEG VRAAARAWAMPLCATRPEIASDTVTAVMTPQGFDATRLVAHASTKYDVAFGVGLGEVSGKLFRIGHLGS LSDVMALSGIATAEMAMADLGLPITLGSGVAAAQEHYRSTQAAEARLAA |
| 527 | MSFQNPVFIPGPTNIPENLRKACDMPTIDHRSPLFGQILHPARAGVQKVLKSTSAEVFIFPSTGTGGWETA LTNTLSAGDTVLAARNGMFSQRWIDMCQRHGLNVNVVETPWGQGVPADRYAEILAADTGHQIKAVLATH NETATGVRSNIAAVRQALDDAGHPAMLFVDGVSSIGSMEFRFDDWGVDVAVTGSQKGFMLPAGLGIVGF SAKAMEATKSAKLPRTFFDVHDMAKGYANSAYPYTPAVGLLNGLNTACGMLLDEGLANVFARHHRIAEG VRAAVGAWGLDLCAASPDLYSDTVSAIRTPEGFNATSIVTHAAEVYGVAFGVGLGEVAGKVFRIGHLGSL TDVMMLSGIATAEMCMADLGLDITLGSGVAAAQDYYRANRAERQQDAA |
| 528 | MFAQNPVFIPGPTNMPEVLRRAADMPTLDHRSPLFAQILHPALAGVKKVLKSEDAEVFIFPSTATGGWET ALSNTLSAGDTVLAARHGMFSHRWIDMTRRHGLDVRMIEAPWGEGLPADRFAEALAADKAHRIRAVLVT HNETATGVRSDVAAVRRALDASNHPALLLVDGVSSIASMDFRMDEWGVDVAVTGSQKGFMLPAGLAIVA FSPKAMAATATATLPRTYFDIRDMAKGYPNGAYPYTPAVGLLNGLKLSTELLLAEGLETVFARHRRIADGI RAAVAAWGLELCAARPDLYSDTVSAIRTPEGFDATRIVTHAARHYDVAFGVGLGEVAGKVFRIGHLGSLT DVMALSGIAAAEMAMVDLGLRIALGSGVAAAQAVYRRAPAAALRAAA |
| 529 | MFAQNPVFIPGPTNMPEVLRRAADMPTLDHRSPLFAQILHPALAGVKKVLKSEDAEVFIFPSTATGGWET ALSNTLSAGDTVLAARHGMFSHRWIDMTRRHGLDVRMIEAPWGEGLPADRFAEALAADKAHRIRAVLVT HNETATGVRSDVAAVRRALDASNHPALLLVDGVSSIASMDFRMDEWGVDVAVTGSQKGFMLPAGLAIVA FSPKAMAATATATLPRTYFDIRDMAKGYPNGAYPYTPAVGLLNGLKLSTELLLAEGLETVFARHRRIADGI RAAVAAWGLELCAARPDLYSDTVSAIRTPEGFDATRIVTHAARHYDVAFGVGLGEVAGKVFRIGHLGSLT DVMALSGIAAAEMAMADLGLRIALGSGVAAAQAVYRRAPAAALRAAA |
| 530 | MTSQNPIFIPGPTNIPEEMRKAVDMPTIDHRSPVFGRMLHPALEGVKKVLKTTQAQVFLFPSTGTGGWET AITNTLSPGDKVLAARNGMFSHRWIDMCQRHGLDVTFVETPWGEGIPADRFEEILTADKGHEIRVVLATH NETATGVKSDIAAVRRALDAAKHPALLFVDGVSSIGSMDFRMDEWGVDIAVTGSQKGFMLPPGLAIVGFS PKAMAAVESARLPRTFFDIRDMATGYARNGYPYTPPVGLINGLNASCERILAEGLENVFARHHRIASGVR AAVEAWGLKLCAVRPELYSDSVSAIRVPEGFDANLIVSHALETYDMAFGTGLGQVAGKVFRIGHLGSLTD AMALSGIATAEMVMADLGLPIKLGSGVAAAQEHYRQTTAAAQKKAA |
| 531 | MSFQNPVFIPGPTNIPENLRKACDMPTIDHRSPLFGQILHPAREGVRKVLKSDSAEVFIFPSTGTGGWETA LTNCLSAGDKVLSARNGMFSHRWIDMCQRHGLDVQIVETPWGEGLPADRFEEILTADTNHEIKAVLATHN ETATGVKSDIAAVRKALDAAGHPALMFVDGVSSIGSMDFRFDEWGVDVAVAGSQKGFMLMAGLAIVGFS EKAMAATQTATLPRTFFDVHDMKKGYANSAYPYTPAVGMLNGLNQACTMLLDEGLENVFARHHRIAEGV RAAVGAWGLELCAASPDLYSDTVSAIRTPEGFNATDIVSHAASKYGVAFGVGLGEVAGKVFRIGHLGSLT DVMTLSGLATAEMCMADLGLDITLGSGVAAAQEYYRGHAVAARKSAA |

FIG. 12AU

| | |
|---|---|
| 532 | MTSQNPIFIPGPTNIPEEMRKAVDMPTIDHRSPVFGRMLHPALEGVKKVLKTTQAQVFLFPSTGTGGWET AITNTLSPGDKVLAARNGMFSHRWIDMCQRHGLDVTFVETPWGEGIPADRFEEILAADKGHEIRVVLATH NETATGVKSDIAAVRRALDAAKHPAMLFVDGVSSIGSMDFRMDEWGVDIAVTGSQKGFMLPPGLAIVGF SPKAMAAVESARLPRTFFDIRDMATGYARNGYPYTPPVGLINGLNASCERILAEGLENVFARHHRIAGGV RAAVEAWGLKLCAARPELYSDSVSAIRVPEGFDANLIVSHALETYDMAFGTGLGQVAGKVFRIGHLGSLT DAMALSGIATAEMVMADLGLPIKLGSGVAAAQEHYRQTTAAAQKKAA |
| 533 | MSFQNPVFIPGPTNIPESLRKACDMPTIDHRSSLFGQILHPARAGVRKILKSETAEVFIFPSTGTGGWETAL TNCLSSGDKVLAARNGMFSHRWIDMCQRHGLDVQVVETPWGEGLPADRYEEILTADTAHKIKVVLATHN ETATGVKSDIAAVRRALDAAGHPALLFVDGVSSIASMDFRMDEWGVDVAVTGSQKGFMLTAGLAIVGFS AKAIEATKSATLPRTFFDINDMTAGYANNAYPYTPAVGLLNGLNEACAMLLNEGLENVFARHHRIAEGVRA AVGAWGLELCAANPSVYSDTVSAIRTPDGFNATDIVTHAASKYGVAFGVGLGEVAGKVFRIGHLGSLTDV MALSGIATAEMCMVDLGLDVRLGSGVAAAQEYYRGHGIEAQKDAA |
| 534 | MSFQNPVFIPGPTNMPECLRRACDMPTLDHRSSLFAEILHPARDGVRQVMKASDAEIFIFPSTGTGGWET AITNTLSRGDTVLAARNGMFSQKWIDMCQRHGLNVKIVEAAWGEGIPTDQFEEILTADKNHQIKAVLATHN ETATGVLSDIAGVRAAMSAAQHPALLFVDGVSSIGSMDFRFDDWGVDVAVTGSQKGFMLPAGLGIAGFS RKAMDAAKTAGLPRTYFDIRDMSKGYAANAYPYTPAVGLLNGLKLACGMLLDEGLDAVFARHARIANGV RGAVEAWGLELCAVRPELYSDTVSAIRTPEGFDAGRIVSHASQNYRVAFGVGLGLVAGKVFRIGHLGSLT DVMTLSGIATAEMVMADLGLDITLGSGVAAAQEIYRSTAAPMVLAAE |
| 535 | VSTQNPIFIPGPTNIPEVLRKAVDMPTIDHRSPMFGKILHPALEGVKKVLKSTQAQVFVFPSTGTGGWETAI TNTLSAGDAVLATRNGMFSHRWIDMCQRHGLDVQIVDQSWGEGIPTDRFEEILTADTAHRIKAVLATHNE TATGVRSDIAAVRRALDRAGHPAMLFVDGVSSIACYDFRMDEWGVDVAVTGSQKGFMLPPGLAIVGFSP KAMTAVEGAGLPRTFFDIRDMARGYAANGFPYTPPVGLLNGLKVATDMLLDEGLENVFARHHRIAEGVR QAVAAWGMTLCAARPTLYSDSVSAIRTPDGFDANRIVSHALNTYGVAFGTGLGDVAGKVFRIGHLGMLT DVMALSGLATAEMVMVDLGLPVTLGSGVAAAQAHYRHSAGQACRQAA |
| 536 | MSFQNPVFIPGPTNIPESLRKACDMPTIDHRSPLFGQILHPAREGVRKILKSASAEVFIFPATGTGGWETAL TNTLSAGDKVLAARNGMFSHRWIDMCQRHGLQVEIVETPWGQGLPADRYADILAADTAHQIKAVLATHN ETATGVKSDIAAVRRALDDAGHPAMLFVDGVSSIGSMDFRFDEWGVDIAVTGSQKGFMLPAGLAIVGFSE KAMAATQTGTLPRTFFDVHDMAKGYANNAYPYTPAVGLLNGLNQSCTMLLAEGLENVFARHRRIAQGVR AAVEAWGLPLCAAHPSLYSDTVSAIRTPEGFNATDIVTHAAEKYGVAYGVGLGEVAGKVFRIGHLGSLTD VMALSGIATAEMCMADLGLDIKLGSGVAAAQDFYRGNPAIACKDAA |
| 537 | MTDQNPVFIPGPTNMPDRLRRAIQIQTRDHRAPDFVDTFAPVLEDTKKVFGSTEGKIITFPASGTGGWEA AVTNTLSPGDKILVGRYGVFSNKWIDLCQRHGLDVQIVETPWGEGVPADKFAEILAADTAHEIKAVLTTHN ETATGVRSDIAAVRRALDGADHPAMLFVDCVSSLASMPFEFDAWGVDIAVSGSQKGFMLPTGMAILCVS PKALAAIETAGLSRTFFDFRDMMKANATGGFPYTPPLQLIYGLRESLDMLFEEGLENVYARHFRLAEGVR RAVDAWGMKLVAKSPDLYSDTVSAVYVPEGFDSNALTDHAYRAYKVSFGVGLGQLDGKAFRIGHLGSLT DVMVLSGLATIEMAMADLNYPITLGSGVAAAQEYYRTSRVAALKSAA |
| 538 | VTGLLVIAITERERLMSDQNPIFIPGPTNIPDRLRFAMNVQSSDHRSPGFVETLSPLLQDCKKVFNTQSGE VILFPASGTGGWEAAICNTLSPGDKVLIARYGMFSRRWIDMCQRHGLDVQIIECPWGSGAPANEFKRALS ADTQHKIKAVLVVHNETATGVKSDIDAVRQAMDSCSHPALLLVDCVSSLASMPFEMDNWGVDIAVSGSQ KGFMLITGMAILAVSQKALAEMETAKLSCAFFDFRAMMTANAQGGFPYTPPLQLICGLKESLKMLFEEGL DNVYARHFRLAEGVRQATHAWGMALCAQSPDLYSNTVTAIYVPEGFDSNELTDHTLAKYGVSFGIGLGE MHGKAFRIGHLGSLTDSMVLSGLATIEMAMADLDYPIELGSGVRAAQNHFRATTA |
| 539 | MFAQNPVFIPGPTNMPEVLRRAADMPTLDHRSPLFAQILHPALAGVKKVLKSEDAEVFIFPSTATGGWET ALSNTLSAGDTVLAARHGMFSHRWIDMTRRHGLDVRMIEAPWGEGLPADRFAEALAADKAHRIRAVLVT HNETATGVRSDVAAVRRALDASNHPALLLVDGVSSIASMDFRMDEWGVDVAVTGSQKGFMLPAGLAIVA FSPKAMAATATATLPRTYFDIRDMAKGYPNGAYPYTPAVGLLNGLKLSTELLLAEGLETVFARHRRIADGI RAAVAAWGLELCAARPDLYSDTVSAIRTPEGFDATRIVTHAARHYDVAFGVGLGEVAGKVFRIGHLGSLT DVMALSGIAAAEMAMADLGLRIALGSGVAAAQAVYRRAPAAALRAAA |
| 540 | MSFQNPVFIPGPTNIPEVIRKACDMPTIDHRSPLFATILHPALDGVRAVMKQTKGETFIFPASGTGGWETA LSNTLNPGDTVLAARNGMFSHKWIDMCQRFGLKVRQVDVTWGEGLPVATFEEILRDDTAGEIKAVLATH NETATGVVSDVGGLRRAMDAAGHGALLLVDGVSSIGSMDFQFDDWGVDVAVTGSQKGFMLPAGLAIVG FSEKAVAASKTNSLPRTFWSIDDMRNGYAANAYPYTPAVGLMNGLKLATEMLLGEGLDNVFARHARIAE GVRAATFAWGMKPCAVSPDLYSNTVTAIRTPEGFNASDIVARAAQEYGMAFGTGLGDVAGKVFRIGHLG SLTDAMALSGIATAEMVMADLGLPIQLGSGVAAAQEIYRHGNTSQRMAAQ |
| 541 | MSFQNPVFIPGPTNIPESLRKACDMPTIDHRSPLFGQILHPALAGVRKVLKSDQAEIFIFPSTGTGGWETAL TNTLSPGDKVLAARNGMFSHRWIDMCQRHGLEVQIVETPWGHGLPADRYEEFLTADKNHEIKVVLATHN ETATGVRSDIAAVRRALDAAGHPAMLFVDGVSSIASMDFRFDEWGVDIAVTGSQKGFMLPPGLAILGFSK KAMAAIDSATLPRTFFDVRDMGKSYGNNAYPYTPAVGLLNGLNQACGMLLDEGLENVFARHHRIAEGVR AAIAAWGLELCAVSPDVYSDTVSAVRTPEGFNATDIVTHAASNYGVAFGVGLGEVAGKVFRIGHLGSLTD VMTLSGIATAEMCMADLGLDISLGSGVAAAQEYYRSTQSAARKDAA |

FIG. 12AV

| | |
|---|---|
| 542 | VTSQNPIFIPGPTNIPEVLRKAVDIPTVDHRSPLFAKILHPALDGVKKVMKTGRAEIIVFPSTGTGGWEAAIT NTLSPGDKVLATRNGVFSHRWIDMCQRHGLDVVVVAQQWGDGIPADRLAEILAADKSHEIKAVLATHNET ATGVRSDIAAVRGALDAAGHPAMLFVDGVSSIGSMDFRMDEWGVDIAVTGSQKGFMLPPGLAIVGLSPK AMESVADGRLPRTFFDVRDMISNYSAGGFPYTPPAGLLNGLKTATEMLLDEGLENVFARHRRIAEGVRR AVDAWELHLCAMRPELYSDTVSAIRVPDGFDANRIVAHALNAYGVSFGTGLMELAGKVFRIGHLGSLTEV MALSGIATAEMAMADLGLAVRLGSGVAAAQEHFRLGAAYARQKAA |
| 543 | MAGFNQLFVPGPTNVPESVRQAMNMPMEDMRAPDYPTFTRGLFTDLMKVFRNETGRAFIFPSSGTGAW ESAITNTLSPGDRVLMSRFGQFSHLWVDMAERFGLDVDVVDVEWGTGVPVEIYAERLAADKEHRIKAVF VTHNETATGVTSDVGAVRAALNAAKHPALLFVDGVSSVGSIDFRQEEWGVDCAVSGSQKGFMLPPGLG FLSVSQKALNAAKTAKFSRCYFSFEDQIRANDTGYFPYTPAVQLLRGLRAALDLIQEEGLDNIFERHHRLA TGVRKAVDAWGLRVCAKEAKWNSDTVSAIVVPEGIDSADIVRRAYNGYQTSLGVGLNKVAGKVFRIGHL GWVNEVMMCGAISAAEMSLRDCGVKVQPGSGVGAALEHYRLSAQPAVAKAA |
| 544 | MSSQNPIFIPGPTNIPEVLRKAVDMPTIDHRSPLFGKILHPALDGVKKVLKTTQAEVFAFPSTGTGGWEMAI SNTLSAGDKVLATRNGMFSHRWIDMCQRHGLDVTVVTQNWGEGIPANIFEEMLVADKAHEIKAVLATHN ETATGVRSDIAAVRRALDAAGHPALLFVDGVSSIGCMDFRMDEWRVDVAVAGSQKGFMLPPGLAIVACS SLALAAAETAGLHRTFFDLRDMAKGYANSGYPYTPPVGLLNGLKLSTEMLLEEGIENVFARHHRIACGVR AAVAAWGLRLCAGRPELYSDTVSAIRVPEGFDANKIVSHALNAYGVAFGTGLGDVAGKVFRIGHLGSLTE VMALAGVATAEMVMVDLGLPITLGSGVAAAQQHYRQSIGSPQLKAA |
| 545 | MSFQNPVFIPGPTNMPEAIRKACDMPTIDHRSPLFGQILHPVRANVREILKSTSAEIFIFPSTGTGGWETAIT NTLSPGDTVLAARNGMFSHKWIDMCQRHGLNVMMVETAWGQGIPTDRFAEILADDKDHKIKAVLATHNE TATGVRSDIAGVRRAMDTSNHPAMLFVDGVSSIASMDFRFDEWGVDVAVTGSQKGFMLPAGLAIVGFSK RAVEATKTAGLHRTFFDINDMTKGYDANAYPYTPAVGLMNGLLLATETLLKEGMENVFARHNRIASGVRA AVDAWGLELCAASPDLYSDTVSAIMTPEGFNASDIVSHAAEKYGVAFGTGLGDVAGKVFRIGHLGSMTDV MALSGIATAEMCMVDLGLDIKLGSGVAAAQEFYMGKTQTVPMKDAA |
| 546 | MSDQNPVFIPGPTNIPDRLRNAMHIQTRDHRAPDFVETFAPVLEDCKRVFGTETGQVITFPASGTGGWEA SICNTLSAGDTVLVARYGMFSHRWIDLCQRHNLEVQVIDCEWGSGAPADLFEQALKADTEKTIKAVLVTH NETATGVKSDIAAVRRAMDAASHPAMLFVDCVSSLASMPFHMDDWGVDIAVSGSQKGFMLATGMAILGV SQKALAAMETATLPRTFFDFRDMMAANASGGFPYTPPLQLIYGMRESLKMLLEEGLDNVYARHFRLAEG VRKAVEAWGMKLCAQSPELYSDTVSAIYVPEGFDSNELTEHAFNAYGVSFGIGLGEMNGKAFRIGHLGSL TDVMVLSGLASIEMAMADLNYPIELGSGVRAAQEYYRATAAANQ |
| 547 | MQGQNPVFIPGPTNIPDRLRHAMNMQTLDHRAPDFVDLLTPVRAGLKKVLKTETAEVVTFPGSGTGGWE AAVSNTLSPGDTVLAARYGMFSHRWIELCQRLGLTVQVIETPWGEGAPADRIEEALAADKGHAIKAVLAT HNETATGVRSDIAAVRRAMDAAGHPAMLYVDGVSSIASMDFRMDEWGVDLAVTGSQKGFMLYTGMAIV GVSRKALQAMETAACPRAYFDFRDMIGANAKGGYPYTPPLQLLFGLGESLKMLLDEEGLDAVFARHHRM AEGVRRAVAAWGMKLCANRPELCSDTVSAIYVPEGFKSDALVNHAFRTYGMSFGVGLGEMAGRAFRIG HLGSLTPSMALSGIATVEMAMADLNYPITLGAGVAAAQDYYRTTAGVPQQKAA |
| 548 | MSFQNPVFIPGPTNMPEEIRLATYMPTIDHRSPVFGGILHPCLDGVRRVLKSETAHIFIFPSTGTGGWETTL TNTLSAGDKVLVARNGMFSHRWIDMCERHGLDVQVVDVAWGEGLPVAEYAAILKADKDHTIKAVLATHN ETATGVKSDIAGVRGALDAANHPALFFVDGVSSIGSMDFRMDEWGVDVAVTGSQKGFMLPAGLAIVGFS EKARAAVESATLPRTFFDIRDMEKGYAANAFPYTPPVGLMNGLKCAIEMIEAEGLENVFARHTRIATGVRH AVEAWGLELCANAPELYSDSVSAIRTPEGFNATDIVTRADEQYGMAFGVGLGDVAGKVFRIGHLGMLTD AMMLSGLGVAEMVMKDLGLDIKLGSGVGAAQEFYRYGS |
| 549 | MYMQNPVFIPGPTNMPEVLRRAADMPTLDHRSPRFAEILHPALAGVRKVIRSASAEVFVFPSTGTGGWE TAITNTLSPGDTVLAARYGMFSHRWIDMCRRHGLNVELVEEAWGNALPVEAYEARLRADRQHRIKAVLA THNETATGVRSDIAAVRRALDAANHPAMLFVDGVSSIASMDFRMDEWGVDIAVTGSQKGFMLPVGLAIVA CSPRAMDMMADAKLPRTFFDIADMRARYADGAYPYTPSVGLLNGLKMATEMLLTEGLDNVYARHRRIAE GVRAAARAWAMPLCATRPEIASDTVTAVMTPQGFDATRLVAHASAKYDVAFGVGLGEVSGKLFRIGHLG SLSDVMALAGIATAEMAMADLGLPITLGSGVAAAQEHYRSTQAAEDRLAA |
| 550 | MFEQNPIFIPGPTNIPDRLRHAMNVQSSDHRSPDFVETLAPLLQDCKKVFGTQSGEVVLFPSSGTGGWE AAICNTLSPGDKVLIARYGMFSHRWIDMCQRHGLDVQIIECSWGSGAPADEFQRALSADTQHEIKAVLVT HNETATGVKSDIGAVREAMDSSAHPALLLVDCVSSLASMPFEMDDWGVDIAVSGSQKGFMLVTGMAILG VSQKALAAMENAELSRTFFDFRGMMAANAQGGFPYTPPLQLIYGLRESLKMLFEEGLDNVYARHFRLAE GVRQAVKAWGLDLCAQSPELHSHTVSAIYVPKGFDSNKLTDHAFSKYGVSFGIGLGEMYGKAFRIGHLG SLTDTMVLSGLATIEMAMADLDYPIELGEGVRAAQSYFRKTAA |
| 551 | MSNQNPVFIPGPTNIPDRLRLAMQVQTQDHRAPDFVNTLAPVLEGTKKVFGSASGQIITFPASGTGGWEA AVTNTLSPGDTVLVARYGMFSHRWIDLCQRHGLDVRIIECAWGSGAPADQFAKALAADTAHQIRAVLVTH NETATGVRSDISAVRKAMDASDHPAMLFVDCVSSLASMPFAFDDWGVDIAVSGSQKGFMLATGMAILCV SPKALAAIETAKLPRTFFDFKDMMNANASGGFPYTPPLQLIYGMRESLNMLFEEGLDNVYARHTRLAEGV RKATAAWGLDLVAQSPELYSDTVSAIYVPEGFDSNALTDHAFNAYGVSFGVGLGEMNGKAFRIGHLGSL TDVMVLSGLATIEMAMADLNYPIDLGSGVSAAQEYFRSGRTTPMKTAA |

FIG. 12AW

| | |
|---|---|
| 552 | MTSQNPVFIPGPTNIPEVLRKAVDMPTIDHRSPVFGRILHPALEGVKKVLKTTDGQVFVFPSTGTGGWET<br>AITNTLSPGDKVLATRNGMFSHRWIDMCQRHGLDVQVVAQEWGEGVPADRFEEILTADKGHEIKVVLAT<br>HNETATGVRSDIAAVRRALDAAGHPALLFVDGVSSIACYDFRMDEWGVDVAVTGSQKGFMLPPGLAIVG<br>FSPKAMAAVETAKLPRTFFDIRDQARGYAANGFPYTPPVGLLNGLNVACQMLLDEGLENVFARHHRIAEG<br>VRRAVAAWGMPLCAKRPDLYSDSVSAIRVPEGFDANKIVSHALNAYGVAFGTGLGDVAGKVFRIGHLGS<br>LTDVMALSGIATAEMVMADLGLPVTLGSSGVAAAQDHYRHSVPAMQKAA |
| 553 | MSFQNPVFIPGPTNIPESLRKACDMPTIDHRSPLFGQILHPAREGVRKVLKSTSAEVFIFPSSGTGGWETA<br>LSNTLSAGDTVLAARNGMFSHRWIDMCQRHGLDVQIVETPWGEGLPADRYEEILSADKGHKIKAVLATHN<br>ETATGVKSDIAAVRRALDAAGHPALLFVDGVSSIASMDFRMDEWGVDVAVTGSQKGFMLSAGLAIVGFS<br>PKAMEATKTAQLPRTFFDVHDMAKGYANNAYPYTPAVGLMNGLNESCKMLLTEGLENVFARHHRIAEGV<br>RAAVGAWGLELCAASPEVYSDTVSAIRTPEGFNATDIVTHAADKYGVAFGVGLGEVAGKVFRIGHLGSLT<br>DVMALSGIATAEMCMVDLGLDIQLGSGVAAAQDYYRGNAASAQQDAA |
| 554 | MYTQNPVFIPGPTNMPEVLRRATDLPTIDHRSAAFADILQPALAGVRKVVKSENAEIVVFPATGSGGWEA<br>TITNLLSPGDKVLAARSGMFSHRWIDMCQRHGLQVDAVHSSWKQPLPLAEYEKRLVADKGHEIKAVLVT<br>HNETATGVKSDVGAVRRLLDDARHPALLLVDGVSSIASMDFRMDEWKIDAAITGSQKGFMLPVGLAILAL<br>SPKAMQATQSAKLHRAFFDIREMAKAYPSSGYPYTPSVGLLNGLKVSTELLLEEGLDNVFKRHARIASGV<br>RAAISAWGLHLYAQEASSYSDTVSAVETPEGFDATSIVTHAAQKYAVAFGAGLGDVAGRVFRIGHLGSMS<br>DVMALSGIATAEMAMADLGLPIRLGSGVAAAQEVYRNTEASPVRNAA |
| 555 | MCQRHGLAVQTVETAWGAGIPADRYEEILTADKSHEIKAVLATHNETATGVKSDIAAVRRALDASGHPAM<br>LLVDGVSSIASMDFRFDEWGVDVAVTGSQKGFMLPAGLAIVGFSPKAMEATKTASLPRTFFDVHDMAKG<br>YANNAYPYTPAVGLLNGLNQACNMLLTEGLENVFARHFRIAEGVRAAVGAWGLELCATDPSVYSDTVSAI<br>RTPEDFNATDIVTHAANKYGVAFGVGLGEVAGKVFRIGHLGSLTDVMALSGIATAEMCMVDLGLDIKLGS<br>GVAAAQEYYRGHTAAAQKDAA |
| 556 | MCQRHGLAVQTVETAWGAGIPADRYEEILTADKSHEIKAVLATHNETATGVKSDIAAVRRALDASGHPAM<br>LLVDGVSSIASMDFRFDEWGVDVAVTGSQKGFMLPAGLAIVGFSPKAMEATKTASLPRTFFDVHDMAKG<br>YANNAYPYTPAVGLLNGLNQACNMLLTEGLENVFARHFRIAEGVRAAVGAWGLELCATDPSVYSDTVSAI<br>RTPEDFNATDIVTHAANKYGVAFGVGLGEVAGKVFRIGHLGSLTDVMALSGIATAEMCMVDLGLDIKLGS<br>GVAAAQEYYRGHTAAAQKDAA |
| 557 | MSFQNPVFIPGPTNMPEVLRKAVDMPTLDHRSPLFGQILHPAIAGVKQVLKSKSAEVFIFPASGTGGWET<br>ALTNTLSAGDKILAARNGMFSHRWIDMCQRHDLDVTIVETPWGEGLPADRYEEILTADTNHEIQAVLATHN<br>ETATGVKSDIAAVRRALDAAGHPALLFVDGVSSIASMDFRMEEWGVDVAVTGSQKGFMLPAGLAIVGFS<br>PKAMEVIETAKLPRTFFDVRDMAAGYANNAYPYTPAVGLLNGLKLSCDMLLGEGLENVFARHNRIASGVR<br>AAVGAWGLDLCAASPDVYSDSVSAIRTPEGFNATDIVTLAAEKYGVAFGVGLGEVAGKVFRIGHLGSLTD<br>VMALSGIATAEMCMVDLGLDITLGSGVAAAQDYYRNQDAAPAKAAA |
| 558 | MSDQNPLFIPGPTNMPDRLRHAMQVQTRDHRAPDFVETLMPVLDGCKTVFGTAEGSVITFPASGTGGW<br>EEAAITNTLSPGDTVLIARYGMFSHRWIDMCERHGLDVRIIECDWGSGAPADKFEEALKADSIHAIKAVLVTH<br>NETATGVKSDIAAVRAAMDSASHPALLLVDCVSSLASMPFEMDAWGVDIAVAGSQKGFMLATGMAILAV<br>SQKALAAMDGATLPRTFFDFRDMLQANSTGGFPYTPPLQLIHGMRESLSMLFEEGLDNVYARHHRLAEG<br>VRQATRAWGLDLVAQSPELYSDTVSAIYVPDGFDSNVLTDHAFNAYGVSFGVGLGQMNGKAFRIGHLGA<br>LTDVMVLSGLATIEMAMADLNYPIELGVGVSAAQEYFRQSWDTALKSAA |
| 559 | MSGYNHLFIPGPTNIPEQVRQAMNLPMEDMRSPQYPELTLPLFADVKKVFKNRNGRVFIYPSSGTAWE<br>AAMTNVLSPGDRVLMSRFGQFSHLWVDMAERLGFEVDCLDMEWGTGVPVELYAERLAADKAHRIKAVF<br>VTHNETATGVTSDVAAARAALDACGHPALLFVDGVSSIGSIDFRQDEWGVDCAVSGSQKGFMLPAGLGF<br>LSVSEKALEAAKTARHMRCYFSFDDMIKTNDTGYFPYTPPTQLLRGLRAALDLMFAEGLENIFARHHHLA<br>NGVRAAVSAWGLKLCATEPKWHSDTVSAIRLPEGVDGVEVIRHAYRTYNTSLGSGLSKIAGKVFRIGHLG<br>SLNEVMVLGALGAAELTLLDCGVKIEPGSGVGAAVKQFRSVTRTSTAKAA |
| 560 | MYLQNPVFIPGPTNMPEVLRKASDMPTIDHRSPLFGEILRPALAGVKKVVKSQSASIFVFPATGTGGWET<br>AITNTLSPGDRVLVARYGMFSHRWIDMCQRHGLDVGVIETPWGSGAPVDRYEEMLTADKAHQIKAVLVT<br>HNETATGVKSDIAALRRALDAARHPAMLFVDGVSSIASMEFRMDDWGVDVAVTGSQKGFMLPAGLAITA<br>FSPKALAALETAKLPRTFFDVRDMSKSYENNAYPYTPAVGLLNGLKVSTEMLLAEGLENVFARHNRIATGI<br>RAAVRAWGLELCAMSEDLYSDTVSAIRTPDGFDATSVVTHAAKKYDVAFGVGLGEVAGKVFRIGHLGSLT<br>DVMALSGVATAEMVMADLGLAIKLGSGVAAAQDYYRNNQVSAGRGAA |
| 561 | MSNQNPVFIPGPTNIPDRLRLAMQVQTQDHRAPDFVETFAPVLEDTKKVFGTTEGQIITFPASGTGGWEA<br>AITNTLSPGDKVLVARYGVFSHRWIDLCERHGLDVQIVECTWGTGAPADRFEAILSADKAHDIKAVLVTHN<br>ETATGVRSDIRAVRHAMNAANHPAMMFVDCVSSLASMPFEFDQWGVDIAVSGSQKGFMLATGMAILCV<br>SPKALAAMETAKLPRTFFDFRDMMAANASGGFPYTPPLQLIYGMRESLKMLFEEGLDNVYARHTRLAEG<br>VRRAANAWGLKLVAQTPDLCSDTVSAIYVPEGFDSNELTDHAFNTYGVSFGIGLGELNGKAFRIGHLGSL<br>TDVMVLSGLATIEMAMADLNYPIELGGGVAAAQEFYRAGTSGHAKAAA |

FIG. 12AX

| | |
|---|---|
| 561 | MPGYNHLFIPGPTNIPEQVRQAMNLPMEDMRSPRYPELTLPLFADVKKVFKNQDGRVFIYPSSGTGAWE AAMTNVLSPGDRLLMSRFGQFSHLWVDMAERLGFEVDCLDREWGTGVPVELYAERLAADKAHEIKAVF VTHNETATGVTSDVAAVRAALDACGHPALLFVDGVSSIGSIDFRQDEWGVDCAVSGSQKGFMLPAGLGF LSVSQKALEAAKTARHMRCYFSFDDMIKTNDTGYFPYTPPTQLLRGLRAALDLIFEEGLENIFARHHHLAN GVRAGVSAWGLKLCATEPKWHSDTVSAIRLPEGIDGAEVIRHAYRTYNTSLGSGLSKVAGKVFRIGHLGS LNEVMVLGALSAAELTLLDCGVAIEPGSGVGAAIKQFRSAAATATAKAA |
| 563 | MYLQNPVFIPGPTNLPEVLRKASDMPTIDHRSPLFGEILRPALAGVKKVVKSEAASIFVFPATGTGGWETAI TNTLSPGDRVLVARYGMFSHRWIDMCKRHGLDVSVIETPWGSGAPVDRYEEMLTADKAHQIKAVLVTHN ETATGVKSDIAAVRHALDSARHPAMLFVDGVSSIASMEFRMDDWGVDVAVTGSQKGFMLPAGLAITAFS PKALAALETAKLPRTFFDVRDMSKSYENNAYPYTPAVGLLNGLKVSTEMLLAEGLENVFARHNRIAAGIRA AVRAWGLELCASSEDLYSDTVSAIRTPDGFDATSVVTHAAKKYDVAFGVGLGEVAGKVFRIGHLGSLTDV MALSGIATAEMVMADLGLGIKLGSGVAAAQEYYRKNQVSGDRGAA |
| 564 | MSDQNPVFIPGPTNIPSRLLNAMHVQTRDHRSPDFVATLAPVISDLKRVFGTDSGNVITFPSTGTGGWEA AICNTLSPGDKVLIARYGMFSHRWIDLCQRHGLNVEIIECSWGSGAPADQFETRLKADSAAEIKAVLVTHN ETATGVLSDIKAVREAMNNANHPAMLYVDCVSSLGCMPFEMDAWGVDVAISGSQKGFMLPTGMAILAVS PKALAAMETAKLPRTFFDFCDMMAANTNGGFPYTPPLQLIYGLKESLAMIFEEGLENVYARHFRLAEGVR KAVAAWGLTLCANSPDLYSQTVTAIYVPEGFDSNQLTDHAFRTYGVSFGIGLGEMNTKAFRIGHLGSLTD VMVLSGLATIEMSMADLKYPIKLGAGVVAAQEYFRKTAN |
| 565 | MTSQNPIFIPGPTNIPEEMRKAVDMPTIDHRSPVFGRMLHPALEGVKKVLKTTQAQVFLFPSTGTGGWET AITNTLSPGDKVLAARNGMFSHRWIDMCQRHGLDVTFVETPWGEGIPADRFEEILTADKGHEIRVVLATH NETATGVKSDIAAVRRALDAAKHPALLFVDGVSSIGSMDFRMDEWGVDIAVTGSQKGFMLPPGLAIVGFS PKAMAAVESARLPRTFFDIRDMATGYARNGYPYTPPVGLINGLNASCERILAEGLENVFARHHRIASGVR AAVEAWGLKLCAVRPELYSDSVSAIRVPEGFDANLIVSHALETYDMAFGTGLGQVAGKVFRIGHLGSLTD AMALSGIATAEMVMADLGLPIKLGSGVAAAQEHYRQTTAAAQKKAA |
| 566 | MSFQNPVFIPGPTNIPENLRKACDMPTIDHRSPLFGQILHPAREGVRKVLKSDSAEVFIFPSTGTGGWETA LTNCLSAGDKVLSARNGMFSHRWIDMCQRHGLDVQIVETPWGEGLPADRFEEILTADTNHEIKAVLATHN ETATGVKSDIAAVRKALDAAGHPALMFVDGVSSIGSMDFRFDEWGVDVAVAGSQKGFMLMAGLAIVGFS EKAMAATQTATLPRTFFDVHDMKKGYANSAYPYTPAVGMLNGLNQACTMLLDEGLENVFARHHRIAEGV RAAVGAWGLELCAASPDLYSDTVSAIRTPEGFNATDIVSHAASKYGVAFGVGLGEVAGKVFRIGHLGSLT DVMTLSGLATAEMCMADLGLDITLGSGVAAAQEYYRGHAVAARKSAA |
| 567 | MSFQNPVFIPGPTNMPDALRKACDMPTLDHRSPLFGEILQPALSGVKKILKSELAEVFIFPSTGTGGWETV ITNTLSPGDKILAARNGMFSHRWIDLCQRHGLDVVIVDTPWGTGLPADRYEEILAADTHHEIKAVLATHNE TATGVKSDIAAVRRALNNAKHPALLYVDGVSSIASMDFRMDEWGVDAAVTGSQKGFMLPAGLAIVGLSP KAQAAVDQGKLPRTFFDIRDMRKSYAVNAYPYTPAVGLLNGLKHSCDMLLSEGLDNVFARHHRIAEGVR AAVHAWGLQLCAGSRDVYSDTVSAIRTPEGFNATDIITHAAGKYGVAFGVGLGEVAGKVFRIGHLGSLTD VMTLSGLATAEMVMADLGLSIKLGSGVAAAQDYYRTEEAVSSKEAA |
| 568 | MSGQNPTFIPGPTNIPEVLRKAVDMPTIDHRSPIFGDILRPALEGVRRVLKTTQAEVFVFPSTGTGGWEAA ITNVLSPGDRVLATRNGMFSHRWIDMCRHGLDVQVVEQSWGEGIPADRYEEILTADRGHTIKVVLATHN ETATGVRSDIAAVRRALDAAKHPALLFVDGVSSIGCMDFRMDDWHVDVAVAGSQKGFMLPAGLAIVACS QRAAQAAEHAQLPRTFFDIRDMRGSYGNGRFPYTPPVGLLNGLKVASDLLLAEGLETVFARHHRIAEGVR RAVAAWGLTVCAARPELYSDTVTAILLPNGVDSDRFVGHAQDAYGVAFGTGLGQLAGKVFRIGHLGSLT DVMALSGIAAAEMVLADLGAAVELGAGVAAAQEYYRKGSAMAQLAA |
| 569 | MFAQNPVFIPGPTNMPEVLRRAADMPTLDHRSPLFAQILHPALAGVKKVLKSEDAEVFIFPSTATGGWET ALSNTLSAGDTVLAARHGMFSHRWIDMTRRHGLDVRMIEAPWGEGLPADRFAEALAADKAHRIRAVLVT HNETATGVRSDVAAVRRALDASNHPALLLVDGVSSIASMDFRMDEWGVDVAVTGSQKGFMLPAGLAIVA FSPKAMAATATATLPRTYFDIRDMAKGYPNGAYPYTPAVGLLNGLKLSTELLLAEGLETVFARHRRIADGI RAAVAAWGLELCAARPDLYSDTVSAIRTPEGFDATRIVTHAARHYDVAFGVGLGEVAGKVFRIGHLGSLT DVMALSGIAAAEMAMVDLGLRIALGSGVAAAQAVYRRAPAAALRAAA |
| 570 | MFAQNPVFIPGPTNMPEVLRRAADMPTLDHRSPLFAQILHPALAGVKTVLKSQDAEVFVFPSTATGGWET ALSNTLSAGDAVLAARHGMFSHRWIDMTRRHGLDVRVIEAPWGEGLPADRFAEALAADTAHRIRAVLVT HNETATGVRSDVAAVRRALDASGHPALLLVDGVSSIASMDFRMDEWGVDVAVTGSQKGFMLPAGLAIVA FSPRMAATATATLPRTYFDVRDMAKGYPNGAYPYTPAVGLLNGLKLSTELLLAEGLDNVFARHRRIADG IRAAVAAWGLELCAARPDLYSDTVSAICAPEGFDATRIVTHAARHYDVAFGVGLGEVAGKVFRIGHLGSLT DVMALSGIAAAEMAMADLGLRIELGSGVAAAQAVYRRAPAAGLRAAA |
| 571 | MTSQNPIFIPGPTNIPEEMRKAVDMPTIDHRSPVFGRMLHPALEGVKKVLKTTQAQVFLFPSTGTGGWET AITNTLSPGDKVLAARNGMFSHRWIDMCQRHGLDVQFVETPWGEGIPADRFEEILTADKAHDIKVVLATH NETATGVKSDIAAVRRALDAAGHPALLFVDGVSSIGSMDFRMDEWGVDIAVTGSQKGFMLPPGLAIVGFS PKAMEAVETAKLPRTFFDIRDMATGYARNGYPYTPPVGLINGLNVACERLLNEGLENVFARHHRIAGGVR AAVDAWGMKLCAVRPALYSDSVSAIRVPEGFDANLIVSHALETYDMAFGTGLGEVAGKVFRIGHLGSLTD AMALSGIATAEMVMADLGLPIKLGSGVAAAQEHYRQSTATAQKKAA |

FIG. 12AY

| 57 2 | MSFQNPVFIPGPTNIPESLRKACDMPTIDHRSPLFGQILHPAREGVRKVLKSESAEVFIFPSTGTGGWETA<br>LSNTLSAGDKVLAARHGMFSDRWIDMCRRHGLDVQVVETPWGEGLPADRFEEILTKDKGHEIKAVLATH<br>NETATGVKSDIAAVRRALDQAGHPAMLFVDGVSSIASIDFRFDAWKVDVAVAGSQKGFMLPAGLAIVGFS<br>EKAMDATRTSTLPRTFFDVNDMAKGYKNNGYPSTPAVGLLNGLNQACGMLLQEGLENVFARHHRIAQG<br>VRAAVGAWGLELCAVDPSVYSDTVSAVRTPAGFNATDIVTHAAHKYGVAFGVGLGEVAGKVFRIGHLGS<br>LTDVMALSGIATAEMCMADLGLKIELGSGVAAAQDYYRGHAAVARKDAA |
|---|---|
| 57 3 | MSTQNPVFIPGPTNIPEVLRKAVDMPTIDHRSPLFGKILHPALEGVKKVLKTREAQVFVFPATGTGGWETA<br>ITNVLSAGDKVLATRNGMFSHRWIDMCQRHGLDVQVVMQEWGEGVPSDRFEEILAADKEHQIKVVLATH<br>NETATGVRSDIAAVRHALDRTKHPALLFVDGVSSIGCYDFRMDDWGVDVAVTGSQKGFMLPPGLAIVGF<br>SPKALQAVETATLPRTFFDIRDMAKGYAANGFPYTPPVGLLNGLKVATDMLLEEGLDNVFARHHRIAEGV<br>RQAVAAWGLKLCAARPELYSDSVSAIRVPEGFDANKIVSHALNTYGVAFGTGLGDVAGKVFRIGHLGSLT<br>DVMALSGIATAEMVMVDLGLPVTLGSGVAAAQDYYRQSANAAQKKAA |
| 57 4 | MSFQNPVFIPGPTNMPEALRRACDMPTLDHRSAAFADILQPAREGVRRILRSATAEVFIFPATGTGGWEV<br>AITNTLSRGDTVLAARNGMFSHRWIDMCQRHGLTVEIVETPWGEGIPADRFEEILRADTDGRIKAVLATHN<br>ETATGVLSDIAAVRAAMDAAGHDALLFVDGVSSIASMPFEFDTWGVDVAVTGSQKGFMLPAGLAITGFSS<br>RALAAVETGGLPRCFYDIRDMAKSYAANGYPYTPAVGLLNGLAQSCEMILTEGLDAVFARHARIAGGVRA<br>AVTAWGLDLCAARPELYSNSVSAIRTPEGFDATRIVTHAADTYGVAFGVGLGEVAGKVFRIGHLGMLTDV<br>LALSGIATAEMAMADLGLDIKLGSGVAAAQEVYRSTAAPMALAAE |
| 57 5 | MTSQNPIFIPGPTNIPEALRKAVDMPTIDHRSPVFGRMLHPALEGVKKVLKTTKGEIFLFPSTGTGGWETAI<br>TNTLSAGDKVLAARNGMFSHRWIDMCQRHGLDVTFVETPWGEGIPADRFEEILTADKGHEIRVVLATHNE<br>TATGVRSDIAAVRRALDNAKHPAMLFVDGVSSIGSMDFRMDEWGVDVAITGSQKGFMLPPGLAITGFSP<br>KAMEAVESARLPRTFFDIRDMATGYARNGYPYTPPVGLINGLNHAVTMLMDEGLENVFARHNRIASGVR<br>AAVKAWGLELCARRPELYSDTVSAILVPEGFDANKIVSRALETYDMAFGTGLGQVAGKVFRIGHLGSLTD<br>AMALSGLAVAEMVMADEGLPIQLGSGVAAAQDVYRNAAKAAQKKAA |
| 57 6 | MSDQNPVFIPGPTNIPDRLLNAMHMQTRDHRAPDFVETFAPVLEDCKHVFGTETGQVITFPASGTGGWE<br>ASITNTLSAGDTVLVARYGMFSHRWIDMCQRHGLEVQVIDCEWGSGAPADKFEQALRADKDKKIKVVLA<br>THNETATGVKSDIAAVRRAMDAAGHPAMLFVDCVSSLASMPFEMDAWGVDIAVSGSQKGFMLSTGMAIL<br>GVSQKALAAMESATLPRTFFDFRDMMAANANGGFPYTPPLQLIYGMRESLKMLFEEGLENVYARHHRLA<br>EGVRRAVEAWGLKLCAKSPELYSDTVSAIYVPEGFDSNKLTEHAFNTYGVSFGIGLGQMNGKAFRIGHLG<br>MLTDVMCLSGLATIEMAMADLNYPVELGSGVRAAQEYYRATAAANQ |
| 57 7 | MSFQNPVFIPGPTNIPESLRKACDMPTIDHRSPLFGQILHPAREGVRHVLKSASAEVFIFPSTGTGGWETA<br>LTNTLSPGDTVLAARNGMFSHRWIDMCQRHGLTVEVVETPWGEGLPAQRYAEILAADKSRRIKAVLATH<br>NETATGVRSDIAAVRRALDEADHPALLFVDGVSSIASMDFRFDDWGVDCAVTGSQKGFMLPPGLAIVGF<br>SEKAMAATKTAKLPRTFFDVTDMAKGYANNAYPYTPAVGLLNGLNESCRMLLDEGLENVFARHHRIAEG<br>VRAAVRAWGLELCAASPEVYSDTVSAIRTPEGFNATDIVSHAAQTYGVAFGTGLGEVAGKVFRIGHLGSL<br>TDVMTLSGLACAEMCMKDLGLDIALGSGVAAAQDFYRANPALARKEAA |
| 57 8 | MSFQNPVFIPGPTNIPESLRKACDMPTIDHRSPLFGQILHPARKGVREILKSVDAEVFIFPSTGTGGWETAL<br>TNCLSAGDKILAARNGMFSHRWIDMCERHGLDVQIVETPWGEGLPADRYEEILTADTQHQIKAVLATHNE<br>TATGVKSDIAAVRRALDAAGHPAMLFVDGVSSIASMDFRMDEWGVDVAVTGSQKGFMLTAGLAIVGFSP<br>KAIAATKSATLPRTFFDINDMTAGYANNAYPYTPAVGLLNGLNEACTMLLNEGLENVFARHHRIAEGVRAA<br>VGAWGLDLCAADPSVYSDTVSAIRTPDGFNATDIVTHAASKYGVAFGVGLGEVAGKVFRIGHLGSLTDVM<br>ALAGIATAEMCMADLGLDIKLGSGVAAAQDYYRGHSAVSQKDAA |
| 57 9 | MSFQNPVFIPGPTNMPEDLRRACDMPTLDHRSPLFGEILHPALEGVAKVVGTKKGEVFVFPATGTAGWE<br>VALTNTLSPGDKVLATRNGMFSHRWIDMCERHGLDVTVIRREWGEGIDAAAVEEALRADPAIKAVLATHN<br>ETATGVVSDIAAVRRAMDAAGSDALLFVDGVSSIASMPFHFDDWGVDVAITGSQKGFMLPPGLAITVFSA<br>KAADAVEGAGLPRTFLDIRDMRKGYAAGGFPYTPPVGLLNGLNLSCRRLLDEGMKGVWARHHHIAEGVR<br>AAVEAWGLELCAVSPELYSDTVSAIRTPEGFDANRLVAHAATRYGVAFGTGLGEVAGKVFRIGHLGSLTE<br>PMALAGIATAEMAMRDLGLEVESGSGTAAAEEVYRGAGAPMAMAAE |
| 58 0 | MSFQNPVFIPGPTNIPESLRKACDMPTIDHRSPLFGQILHPAREGVRKVLQSESAEIFIFPSTGTGGWETAL<br>SNTLSSGDTVLAARNGMFSHRWIDMCQRQRLRVEIVETPWGEGLPADRYAEILAADKHHRIKAVLATHNE<br>TATGVRSDIAAVRHALDAAGHPALLFVDGVSSIGSMDFRFDEWGVDCAVTGSQKGFMLPPGLAIVGFSE<br>KAMEATKIAMLPRTFFDVHDMAKGYANNAYPYTPAVGLMNGLNEACRMLLDEGLENVFARHHRIAEGVR<br>CAVRAWGLNLCAASPDIYSDTVSAIRTPKGFNATDIVSHAAQTYGVAFGTGLGEVAGKVFRIGHLGSLTD<br>VMMLSGLATAEMCMADLGLDITLGSGVAAAQEFYRATPALSRKVAAE |
| 58 1 | MSNQNPVFIPGPTNIPDRLRLAMQVQTQDHRAPDFVETFAPVLEDTKKIFGAAEGQIVTFPASGTGGWEA<br>AVTNTLSPGDKVLVARYGVFSHRWIDLCERHGLDVQVVECPWGTGAPADRFEAILSADNAHEIKAVLVTH<br>NETATGVRSDISAVRHAMNAATHPAMMFVDCVSSLASMPFEFDQWGVDIAVSGSQKGFMLATGMAILCV<br>SPKALAAMKTANLPRTFFDFRDMMAANASGGFPYTPPLQLIYGMRESLKMLFEEGLENVYARHTRLAEG<br>VRRAVDAWGLKLVAQSPDLYSETVSAIIVPEGFDSNELTDHAFNTYGVSFGIGLGELNGKAFRIGHLGSLT<br>DVMALSGLATIEMAMADLNYPVELGSGVAAAQEFYRAGSSSHAQAAA |

FIG. 12AZ

| | |
|---|---|
| 582 | MSLQNPVFIPGPTNIPDAIRKACDMPTMDHRSAAFADILHPALNGARQVMGQSTGETFVFPSTGTGGWE<br>TAIANTLSPGDRVLAARNGMFSHKWIDMCQRFGLQVTQIDVEWGEGVPTAAFEEALRADTGGGIKAVLA<br>THNETATGVVSDIAGVRRALDAAGHGALLLVDGVSSIGSMPFDFDGWGVDVAVTGSQKGFMLPVGLAIV<br>GFSDKAVAASQTATLPRTFFSIDDMRKGYAANGYPYTPAVGLLNGLKLSTAMLLDEGLENVFARHARIAS<br>GVRAAVAAWGLELCAKSPELYSNTVTAVRTPEGFDASRIVETASRDYGMAFGTGLGDVAGKVFRIGHLG<br>SMTDAMALSGIATAEMVMADLGLDITLGAGVAAAQSVYRHGAQTERMAAQ |
| 583 | MSFQNPVFIPGPTNIPESLRKACDMPTIDHRSPLFGQILHPARDGVRKVLKSTSAEVFIFPSSGTGGWETA<br>LSNTLSAGDTVLAARNGMFSHRWIDMCQRHGLDVQIVETPWGAGLPADRYEEILSADKAHKIKAVLATHN<br>ETATGVKSDIAAVRRALDAAGHPALLFVDGVSSIASMDFRMDEWGVDVAVTGSQKGFMLSAGLAIVGFS<br>PKAMEATKTAQLPRTFFDVHDMAKGYANNAYPYTPAVGLMNGLNESCKMLLAEGLENVFARHHRIAEGV<br>RAAVGAWGLELCAASPEVYSDTVSAIRTPEGFNATDIVTHAADKYGVAFGVGLGEVAGKVFRIGHLGSLT<br>DVMALSGIATAEMCMVDLGLDIRLGSGVAAAQEYYRGNAASAQQDAA |
| 584 | MSFQNPVFIPGPTNMPEALRKAVDMPTLDHRSPLFGQILHPALAGVKKVLKSETAEIFVFPSTGTGGWET<br>AITNTLNAGDKILAARNGMFSHRWIDMCQRHGLDVQIVETPWGEGLPADRYEEILTADTAHEIKVVLATHN<br>ETATGVKSDIAAVRRALDAAGHPALLFVDGVSSIASMDFRMDEWGVDIAVTGSQKGFMLPPGLAIVGFSP<br>KAMKAAETATLPRTFFDIKDMANGYANSAYPYTPSVGLLNGLNMACGMLLDEGLENVFARHHRIAEGVR<br>AAVRAWGLELCAVSPEVYSDSVSAIRTPDGFDANTFVSLAAEKYGVAFGTGLGEVAGKVFRIGHLGSLTD<br>VMTLSGIATAEMVMADLGLNIKLGSGVAAAQDYYRVNSASSAKAAA |
| 585 | MSFQNPVFIPGPTNMPEALRKAVDMPTLDHRSPLFGQILHPALAGVKKVLKSETAEIFVFPSTGTGGWET<br>AITNTLNAGDKILAARNGMFSHRWIDMCQRHGLDVQIVETPWGEGLPADRYEEILTADTAHEIKVVLATHN<br>ETATGVKSDIAAVRRALDAAGHPALLFVDGVSSIASMDFRMDEWGVDIAVTGSQKGFMLPPGLAIVGFSP<br>KAMKAAETATLPRTFFDIKDMANGYANSAYPYTPSVGLLNGLNMACGMLLDEGLENVFARHHRIAEGVR<br>AAVRAWGLELCAVSPEVYSDSVSAIRTPDGFDANTFVSLAAEKYGVAFGTGLGEVAGKVFRIGHLGSLTD<br>VMTLSGIATAEMVMADLGLNIKLGSGVAAAQDYYRGNSASSAKAAA |
| 586 | MTSQNPIFIPGPTNIPEEMRKAVDMPTIDHRSPVFGRMLHPALEGVKKVLKSTQAQVFVFPSTGTGGWET<br>AITNTLSPGDKVLAARNGMFSHRWIDMCQRHALDVTFVETPWGEGVPADRFEEILTADKGHEIRVVLATH<br>NETATGVKSDIAAVRRALDAAKHPALLFVDGVSSIGSMDFRMDEWGVDIAVTGSQKGFMLPPGLAIVGFS<br>PKAMEAVETARLPRTFFDIRDMATGYARNGYPYTPPVGLINGLNLSCERLLSEGLENVFARHNRIASGVR<br>AAVGAWGLKLCAVRPELYSDSVSAIRVPEGFDANRIVSHALETYDMAFGTGLGEVAGKVFRIGHLGSLTD<br>AMALSGISVAEMVMADLGLPIKLGSGVAAAQEHYRQTAAAAQKKAA |
| 587 | MSFQNPVFIPGPTNIPESLRKACDMPTIDHRSPLFGQILHPAREGVRKVLKSDSAEIFIFPSTGTGGWETAL<br>TNTLSAGDTVLAARNGMFSHRWIDMCQRHGLKVDIVETAWGEGLPADRYAEILAADTAHEIRAVLATHNE<br>TATGVKSDIAAVRRALDAAGHPAMLFVDGVSSIASMDFRFDEWGVDVAVTGSQKGFMLPAGLAIVGFSR<br>KAMDATRTGTLPRTFFDVHDMAKGYASNAYPYTPAVGLLNGLNQACDLLLREGLENVFARHHRIAEGVR<br>AAVRAWGLDLCAVDPSVYSDTVSAIRTPEGFNATDIVTHAAEKYGVAFGVGLGEVAGKVFRIGHLGSLTD<br>VMALSGIATAEMCMADLGLDIKLGSGVAAAQDYYRGHPAEAHKDAA |
| 588 | MSNQNPVFIPGPTNIPDRLRLAMQVQTQDHRAPDFVQTFAPVLEDTKKVFDTATAQIVTFPASGTGGWE<br>AAITNTLSPGDKVLIARYGVFSHRWIDLCTRHGLDVQVIDCPWGSGAPADQFQTVLTGDKAHEIRAVLVTH<br>NETATGVLSDIGAVRRAMDAANHPALLMVDCVSSLASVPFEFDRWGVDIAVSGSQKGFMLATGMAILCV<br>SQKALDAMETAELHRTFFDFRDMMAANATGGFPYTPPLQLIYGLRESKLMLFEEGLPNVYARHHRLAEG<br>VRRAVDAWGLELVAQSPDLYSDTVSAIYVPEGFDSNILTDHAFNTYGMSFGVGLGQLHGKAFRIGHLGSL<br>TDAMVLSGLCTIEMAMADLSYPITLGSGVAAAQEHFRATPGNRTEAAA |
| 589 | MSFQNPVFIPGPTNIPESLRKACDMPTIDHRSPLFGQILHPAREGVRKVLKSESAEIFIFPSTGTGGWETAL<br>TNTLSAGDKILAARNGMFSHRWIDMCQRHNLDVQVVETPWGEGLPADRYEEILTADTNHEIKAVLATHNE<br>TATGVKSDIAAVRRALDAAGHPALLFVDGVSSIASMDFRMDEWGVDVAVTGSQKGFMLTAGLAIVGFSA<br>KAMAATETAKLPRTFFDVHDMAKGYAANAYPYTPAVGLLNGLNEACTMLLNEGLENVFARHTRIAEGVR<br>AAVGAWGLELCAANPSVYSDTVSAIKTPEGFNATDIVTHAAEKYGVAFGVGLGEVAGKVFRIGHLGSLTD<br>VMALSGIATAEMCMVDLGLDIKLGSGVAAAQDYYRGNTATAQKDAA |
| 590 | MCQRHGLAVQTVETAWGAGIPADRYEEILTADKSHEIKAVLATHNETATGVKSDIAAVRRALDASGHPAM<br>LLVDGVSSIASMDFRFDEWGVDVAVTGSQKGFMLPAGLAIVGFSPKAMEATKTASLPRTFFDVHDMAKG<br>YANNAYPYTPAVGLLNGLNQACNMLLTEGLENVFARHFRIAEGVRAAVGAWGLELCATDPSVYSDTVSAI<br>RTPEDFNATDIVTHAANKYGVAFGVGLGEVAGKVFRIGHLGSLTDVMALSGIATAEMCMVDLGLDIKLGS<br>GVAAAQEYYRGHTAAAQKDAA |
| 591 | MSLQNPIFIPGPTNIPDRLRRAMNVPTQDHRAPDFSDTFLPVLADCKKVFGTQDGEIILFTSSGTGGWEAA<br>ISNTLSPGDKVLIARYGMFSHRWIDMCQRHGLDVQVVECDWGTGAPADKFQAILNEDTAHEIKAVMVTH<br>NETATGVLSDIGAVRKAMDSSDHPALLFVDGVSSIACVPFEMDAWGVDVAVAGSQKGFMLATGMAILGV<br>SQKALSHMDEAKLPRTYFAFRDMLNANANGGFPYTPPLNLIYGLRESLEMLFDEGLDNVYARHYRLAEG<br>VRQAVSAWGMKLCAKTPDLYSNTVSAIFVPEGFDSNKLTDHAFNKYGISFGIGLGEMNGKAFRIGHLGSL<br>TEVMVLAGLATIEMAMVDLGYPIKLGQGVAAAQEYYRHSAPTK |

FIG. 12BA

| | |
|---|---|
| 592 | MSFQNPVFIPGPTNMPEALRKAVDMPTLDHRSPLFGQILHPALAGVKKVLKSETAEIFVFPSTGTGGWET AITNTLNAGDKILAARNGMFSHRWIDMCQRHGLDVQVVETPWGAGIPADRYEEILTADKAHEIKVVLATHN ETATGVKSDIAAVRRALDAAGHPALLFVDGVSSIASMDFRMDEWGVDIAVTGSQKGFMLPPGLAITGFSP KAMKAAETATLPRTFFDIKDMAKGYANSAYPYTPSVGLLNGLNMACGMLLDEGLENVFARHHRIAEGVR AAVRAWGLELCAVSPEVYSDSVSAIRTPEGFDANTFVSLAAEKYGVAFGTGLGEVAGKVFRIGHLGSLTD VMALSGIATAEMVMADLGLGIQLGSGVAAAQDYYRGNTASSAKAAA |
| 593 | MSFQNPVFIPGPTNMPEAVRQACYMPTIDHRSPVFGKILHPCLEGVQKVLKSDSARIFIFPSTGTGGWET ALTNALSAGDGVLAARNGMFSHRWIDMCQRHGLDVTIVETPWGHGLPADRYEEILRADTGHRIKAVLAT HNETATGVRSDIAAVRRALDAAGHPAMLFVDGVSSIGSMDFRFDEWGVDVAVTGSQKGFMLPAGLAIVG FSDKAMAAVETTTLPRTFFDIRDMAKGYAANAFPYTPPVGLMNGLKLSLDMLLSEGLENVFARHHRIAEG VRRAVGAWGLDLCAASPDLYSDSVSAIRTPEGFNATDIVTRAANEYGMAFGVGLGEVAGKVFRIGHLGSL TDAMMLSGLGVAEMVMVDLGLEVRLGSGVAAAQDYYRHGSGKTNKAAA |
| 594 | MFAQNPVFIPGPTNMPEVLRRAADMPTLDHRSPLFAQILHPALAGVKTVLKSEDAEVFIFPSTATGGWET ALSNTLSAGDTVLAARHGMFSHRWIDMTRRHGLDVRMIEAPWGEGVPADRFAEALAADTAHRIRAVLVT HNETATGVRSDVAAVRRALDASNHPALLLVDGVSSIASMDFRMDAWGVDVAVTGSQKGFMLPAGLAIVA FSPKAMAATATATLPRTYFDIRDMAKGYPNGAYPYTPAVGLLNGLKLSTELLLAEGLENVFARHRRIADGI RAAVAAWGLELCAARPDLYSDTVSAIRTPEGFDATRIVTHAARHYDVAFGVGLGEVAGKVFRIGHLGSLT DVMALSGIAAAEMAMADLGLRIELGSGVAAAQAVYRRAPAAALRAAA |
| 595 | MFAQNPVFIPGPTNMPEVLRRAADMPTLDHRSPLFAQILHPALAGVKKVLKSEDAEVFIFPSTATGGWET ALSNTLSAGDTVLAARHGMFSHRWIDMTRRHGLDVRMIEAPWGEGLPADRFAEALAADKAHRIRAVLVT HNETATGVRSDVAAVRRALDASNHPALLLVDGVSSIASMDFRMDEWGVDVAVTGSQKGFMLPAGLAIVA FSPKAMAATATATLPRTYFDIRDMAKGYPNGAYPYTPAVGLLNGLKLSTELLLAEGLETVFARHRRIADGI RAAVAAWGLELCAARPDLYSDTVSAIRTPEGFDATRIVTHAARHYDVAFGVGLGEVAGKVFRIGHLGSLT DVMALSGIAAAEMAMVDLGLRIALGSGVAAAQAVYRRAPAAALRAAA |
| 596 | MRTGQTHLFIPGPTNIPESVRQAMNVPMQDMRAPDFGALTLGLFDGLRRVMRSASAEVFLFPGSGTGA WEAAITNTLNPGDKVLMSRHGQFSTLWVEMAERLGLDVEVIDVPWGQGVPVAEFERRLGEDREDAIKAV FVTHNETATGVTSDVAGVRRALDETFHDALLFVDGVSSIASIDFRMDEWGVDLAVTGSQKGLMCPAGLGI LAVSEKAMDASTRSTMRRAYFEFSDMRKMNADGYFPYTPPTQILHGLAKSLARIEAEGLDAVIARHHRLA EGVRRGVSAWGLDLVAAEPALYSDTVSAIRVPEAVDAREVIRIAYEEYNTSFGTGLAQLAGKVFRIGHLG DLNEGMCLSALGIAEMALARSGVRLQLGSGVAAAQAFYAFGTEARERIALAAE |
| 597 | MHFQNPVFIPGPTNIPERLRRACDLPTIDHRSPRFGDILHPAREGVRRVMKSETAEIFLFPASGTGGWEAA ITNTLSAGDRVLVSRYGMFSHRWIDLCQRHGLDVTIIDAPWGDALPVERCAEVLAADKSHEYKAVLATHN ETATGVRSDIAGLRRAMDGAGHPALLMVDGVSSIASMDFRFDEWRVDVAVTGSQKGFMLPPGLAILGFS QKAMAASKEARLSRTYFDVHDMAKGYAQNAYPYTPTPGLLNGLAMACDMLLDEGLENVFARHHLIAEGV RAAVRAWGLELCATAPEISSDTVSAIRTPEGFDASRIVAHAAQTYDVAFGAGLGEVAGKVFRIGHLGSLTD VMALAGLATAEMCMVDLGLDIRLGSGVAAAQEFYRTEQGLRAVAA |
| 598 | MLRASFVEKFKKGAVMSFQNPVFIPGPTNMPEGLRKAVDMPTLDHRSSLFADILHPALAGVKKVLKSETA EVFIFPSTGTGGWETALTNTLSAGDKVLAARNGMFSHRWIDMCTRHGLDMTVVDAPWGAGIPLDRYEDI LRKDVNHEIKVVLATHNETATGVRSDIAGVRRAMDAAGHPALLYVDGVSSIGSMDFQMDAWGVDIAVTG SQKGFMLPAGLAIVAFSPKAVARTETAGLARTFFDVRDMAAGYANNAYPYTPAVGLLNGLKTSTEMLLEE GLEAVFARHTRIANGVRAAVDAWGLALCAASPDLYSDTVSAIVTPQGFNATDIVTHAADVYDVAFGVGLG DVAGKVFRIGHLGSMTDVMALAGIATAEMCMVDLGLDIQLGAGVAAAQESYRASTADARRAAA |
| 599 | MISQNPVFIPGPTNMPEVLRKSCDMPTLDHRSAAFAGILHPALEGVKKVLKTTSAEVFVFPSTGTGGWET ALTNTLSPGDTVLVGRNGMFSHRWIDMCERHGLDVIVLDTAWGQGLPVDRYGEVLAQDTEHRIKAVLAT HNETATGVVSDIAGLRAAMDASDHPALLLVDGVSSIGSMNFEMDAWGVDIAVTGSQKGFMLPAGLAIVG VSQRALGAMATAKLPRTFFDLRDMQKGYAVNGYPYTPPVGLLNGLKLACDMLLEEGLENVFARHRRIAD GVRAAVAAWGLELCAERPEWQSDTVSAVRTPEGFDAGEIVTHAAEVYDMAFGVGMGEVAGKVFRIGHL GMLTEAQALCGLATVEMCMVDLGLDIQLGSGVAAAQGVYRHGTRQQAMAAE |
| 600 | MFAQNPVFIPGPTNMPEVLRRAADMPTLDHRSPLFAQILHPALAGVKKVLKSEDAEVFIFPSTATGGWET ALSNTLSAGDTVLAARHGMFSHRWIDMTRRHGLDVRVIEAPWGEGLPADRFAEALAADKAHRIRAVLVT HNETATGVRSDVAAVRRALDASNHPALLLVDGVSSIASMDFRMDAWGVDVAVTGSQKGFMLPAGLAIVA FSPKALAATATATLPRTYFDIRDMAKGYPNGAYPYTPAVGLLNGLKLSTELLLAEGLETVFARHRRIADGIR AAVAAWGLELCAARPDLYSDTVSAIRTPEGFDATRIVTHAARHYDVAFGVGLGEVAGKVFRIGHLGSLTD VMALSGIAAAEMAMADLGLRIALGSGVAAAQAVYRRAPAAALRAAA |
| 601 | MTSQNPIFIPGPTNIPEEMRKAVDMPTIDHRSPVFGRMLHPALEGVKKVLKTTQAQVFLFPSTGTGGWET AITNTLSPGDKVLAARNGMFSHRWIDMCQRHGLDVTFVETPWGEGIPADRFEEILAADKGHEIRVVLATH NETATGVKSDIAAVRRALDAAKHPAMLFVDGVSSIGSMDFRMDEWGVDIAVTGSQKGFMLPPGLAIVGF SPKAMAAVESARLPRTFFDIRDMATGYARNGYPYTPPVGLINGLNASCERILAEGLENVFARHHRIAGGV RAAVEAWGLKLCAARPELYSDSVSAIRVPEGFDANLIVSHALETYDMAFGTGLGQVAGKVFRIGHLGSLT DAMALSGIATAEMVMADLGLPIKLGSGVAAAQEHYRQTTAAAQKKAA |

FIG. 12BB

| | |
|---|---|
| 602 | MYMQNPVFIPGPTNMPEILRKAADMPTLDHRSPLFGQILRPALAGVKKILKTEAASVYVFPSTGTGGWET<br>AITNTLSPGDRVLAARYGMFSQRWIDMCQRHGLKVDIIEAAWGGGAPAARYEEILAADTAHEIKAVLVTHN<br>ETATGVKSDIAAVRRAIDAARHPALLFVDGVSSIASMDFRMDEWLVDIAVTGSQKGFMLPAGLAITAFSPK<br>ALAAVETAKLPRTFFDIGDMARSYANNAYPYTPAVGLLNGLKLSTELLLAEGLENVFARHRRIASGIRAAV<br>RAWGLELCAMSEDLYSDTVSAIRTPEGFDATSIVAHAAKTYDVAFGVGLGEVAGKVFRVGHLGSLTDVM<br>ALSGIATAEMVMVDLGLDIKLGSGVAAAQDYYRDGRTSKVRAAA |
| 603 | MSTQNPIFIPGPTNIPELLRKAVDMPTIDHRSPLFGKILHPALAGVKQVLKSTRAEVFVFPATGTGGWETAI<br>TNTLSPGDKVLATRNGMFSHRWIDMCRRHGLDVQVVMQDWGEDVPAARFEEILTADTAHEIKVVLATHN<br>ETATGVRSDIAAVRRAMDAAGHPALLFVDGVSSIGCYDFRMDEWGVDVAVTGSQKGFMLPPGLAIVGFS<br>PRAMAAVEMAALPRTFFDIRDMAKGYAVNGYPYTPPVGLLNGLKLATEMLLGEGLDNVFARHHRIAEGV<br>RRAVAAWGMKPCAARPELYSDSVTAIRTPEGFDANRIVSRALDSYGVAFGTGLGDVAGKVFRIGHLGSLT<br>DVMALSGIATAEMVMADLGLPVVLGSGVAAAQDHYRRTAPAAPATA |
| 604 | MSFQNPVFIPGPTNMPEDIRKACDMPTIDHRSPLFGQILHPARAGVQKVLKSDYAEIFIFPSTGTGGWETA<br>ITNTLSHGDKVLIARNGMFSHKWIDMCQRHKLEVEIVEVPWGQGIPADRYGDILAADTNHEIRAVLATHNE<br>TATGVKSDIAAIRAVMDACDHPALLLVDGVSSIGSMDFRFDEWKVDVAVTGSQKGFMLPAGLAIVGFSPK<br>AMGATKTARLPRTFFDVHDMAKGYDNNAYPYTPAVGLMNGLKLACDKLLAEGLDNVFARHHRIASGVRA<br>AVDAWGLDLCAVDASVYSDSVSAIVTPGGFNASDIVTLAAEKYGVAFGTGLGEVAGKVFRIGHLGSLTDV<br>MALSGIATAEMCMVDLGLDITLGSGVAAAQEYYRGNAVKSLREAA |
| 605 | MSGQNPTFIPGPTNIPEVLRKAVDMPTIDHRSPIFGDILRPALEGVRRVLKTTQAEVFVFPSTGTGGWEAA<br>ITNVLSPGDRVLATRNGMFSHRWIDMCRHGLDVQVVEQSWGEGIPADRYEEILTADRGHTIKVVLATHN<br>ETATGVRSDIAAVRRALDAAKHPALLFVDGVSSIGCMDFRMDDWHVDVAVAGSQKGFMLPAGLAIVACS<br>QRAAQAAEHAQLPRTFFDIRDMRGSYGNGRFPYTPPVGLLNGLKVASDLLLAEGLETVFARHHRIAEGVR<br>RAVAAWGLTVCAARPELYSDTVTAILLPNGVDSDRFVGHAQDAYGVAFGTGLGQLAGKVFRIGHLGSLT<br>DVMALSGIAAAEMVLADLGAAVELGAGVAAAQEYYRKGSAMAQLAA |
| 606 | MFAQNPVFIPGPTNMPEVLRRAADMPTLDHRSPLFAQILHPALAGVKKVLKSEDAEVFIFPSTATGGWET<br>ALSNTLSAGDTVLAARHGMFSHRWIDMTRRHGLDVRMIEAPWGEGLPADRFAEALAADKAHRIRAVLVT<br>HNETATGVRSDVAAVRRALDASNHPALLLVDGVSSIASMDFRMDEWGVDVAVTGSQKGFMLPAGLAIVA<br>FSPKAMAATATATLPRTYFDIRDMAKGYPNGAYPYTPAVGLLNGLKLSTELLLAEGLETVFARHRRIADGI<br>RAAVAAWGLELCAARPDLYSDTVSAIRTPEGFDATRIVTHAARHYDVAFGVGLGEVAGKVFRIGHLGSLT<br>DVMALSGIAAAEMAMVDLGLRIALGSGVAAAQAVYRRAPAAALRAAA |
| 607 | MSNQNPVFIPGPTNIPDRLRAAMQVQTQDHRAPDFVETFAPVLEDTKSVFGTQQGQVITFPSSGTGGWE<br>AAITNTLSPGDKVLVARYGVFSHRWIDLCARHGLDVQVIECAWGDGAPAATFQSILADDVGREIRAVLVTH<br>NETATGVYSDIAAVRQAIDAAGHPAMLFVDCVSSLASMPFEFDNWGVDVAVSGSQKGFMLAAGMAILCV<br>SPKALAAMDAATLPRTYFDLADMMAANASGGFPYTPPLQLIYGMRESLRMLFEEGLDNVYARHFRLAEG<br>VRRAVDAWGLKLVATSPKLYSDTVSAIYVPDGFDSNALTDHAFNTYGVSFGIGLGQLNGKAFRIGHLGSL<br>TDVMVLSGLATIEMAMADLNYPIELGSGVAAAQDYFRSGSQGRAQAAA |
| 608 | MSFQNPVFIPGPTNMPEAVRQACYMPTIDHRSPVFGKILHPCLEGVQKVLKSDSARIFIFPSTGTGGWET<br>ALTNALSAGDGVLAARNGMFSHRWIDMCQRHGLDVTIVETPWGHGLPADRYEEILRADTGHRIKAVLAT<br>HNETATGVRSDIAAVRRALDAAGHPAMLFVDGVSSIGSMDFRFDEWGVDVAVTGSQKGFMLPAGLAIVG<br>FSDKAMAAVETTTLPRTFFDIRDMAKGYAANAFPYTPPVGLMNGLKLSLDMLLSEGLENVFARHHRIAEG<br>VRRAVGAWGLDLCAASPDLYSDSVSAIRTPEGFNATDIVTRAANEYGMAFGVGLGEVAGKVFRIGHLGSL<br>TDAMMLSGLGVAEMVMVDLGLEVRLGSGVAAAQDYYRHGSGKTNKAAA |
| 609 | MSFQNPVFIPGPTNMPEAIRKACDMPTIDHRSPLFGQILHPARAGVQKILKSDTAEVFIFPSTGTGGWETA<br>LTNTLSPGDTVLAARNGMFSHRWIDMCQRHGLDMQIVETPWGQIPADRYAEILKADTAHKIKVVLATHN<br>ETATGVKSDIAAVRKALDAAGHPAMLFVDGVSSIGSMDFRFDEWGVDVAVTGSQKGFMLPAGLAIVGFS<br>QKALAASKTAKLPRTFFDIADMTKGYAANAYPYTPAVGLMNGLLLATEMLLKEGLENVFTRHNRIASGVR<br>AAVDAWGLELCAETPDLYSDTVSAVKTPDGFNATDIVTLAAEKYGVAFGVGLGEVAGKVFRIGHLGSMTD<br>VMALSGIATAEMCMVDLGLDIQLGSGVAAAQEYYRGSTGLKMRDAA |
| 610 | MSGFKGLAVPGPTNMPFEIRRAMDVALEDHRAPDFPDFIKPLLADLKKVFQTETGQVFVFPGSGTGGWE<br>SAIANTLAPGDTVLASIFGQFSYLWVDMCRKFGLNVDAIECEWGTGVPADLYEQKLAADKEHKIKAVLVT<br>QNETATGVTSDVKAVREALDRTGHPALLFVDGVSSIGSIDFRQDEWGVDVAVSGSQKGFMLPTGLAIVG<br>VSRKALAHRPEGGLPRCFFDYQDMAKTNADGFFPYTPATTLLRGLRASLDMIFDEGLENIFARHHRLAEG<br>VRRAVDAWGMSLCAKEAKWNSDTVSAIVVPEGYNANDVIQTAYHKYDLSLGAGLSKVAGKVFRIGHLGY<br>LNEIMVLQALGGAELAMRDVGLPFTPGVGVGAAVEYYAATGQAEALAAQ |
| 611 | MSDQNPVFIPGPTNIPDRLRMAMSMQTKDHRAPDFVETFAPVLEDTKRVFGTAEGEIILFPGSGTGGWEA<br>AITNTLSPGDAVLIARYGMFSHKWIDMCERHGLDVRVVECPWGEGAPAERFGEILADDTAGEIKAVLVTH<br>NETATGVMSDISLVRKAMDGANHDALLLVDCVSSLACVPFEMDAWGVDIAVSGSQKGFMLQTGMAILGV<br>SQKALNTMEGAKLPRTYFDFRDMRKAYVGGGYPYTPPVQLIQGLRTSLDMLFEEGLGAVYDRHVRLAEG<br>VRRAASAWGLSLCAARPELYSQTVSAIYVPSGFDSNALTEHAYRAYGVSFGVGLGEMNGKAFRIGHLGM<br>LTDVMVSGLATIEMAMADLGYPIELGSGVAAAQEHYRASRANALRSAA |

FIG. 12BC

| | |
|---|---|
| 61 2 | MSFQNPVFIPGPTNMPEALRKAVDMPTLDHRSPLFGQILHPALAGVKKVLKSETAEIFVFPSTGTGGWET AITNTLNSGDKILAARNGMFSHRWIDMCQRHGLDVQVVETPWGEGLPADRYEEILTADTSHQIKAVLATH NETATGVKSDIAAVRRALDAAGHPALLFVDGVSSIASMDFRMDEWGVDIAVTGSQKGFMLPPGLAIVGFS PKAMKAAETATLPRTFFDIKDMANGYANSAYPYTPSVGLLNGLNMACGMLLDEGLENVFARHHRIAEGV RAAVRAWGLELCAVSPDVYSDSVSAIRTPDGFDANKFVSLAAEKYGVAFGTGLGEVAGKVFRIGHLGSLT DVMALSGIATAEMVMADLGLNIQLGSGVAAAQDYYRGNTASSTKAAA |
| 61 3 | MSFQNPVFIPGPTNMPEALRKACDMPTIDHRSPLFGQILHPAREGVRKILKSDSAEIFIFPSTGTGGWETA LTNTLSAGDKVLAARNGMFSHRWIDMCQRHGLKVEVVETPWGEGLPADRYEEILTADTGHEIKVVLATH NETATGVKSDIAAVRRALDAAGHPALLFVDGVSSIASMDFRFDEWGVDVAVTGSQKGFMLPAGLAIVGFS AKAMQATGTGTLPRTFFDVHDMAKGYANNAYPYTPAVGLLNGLNDACAMLLGEGLDNVFARHHRIAEGV RAAVRAWGLDLCARSPEVYSDTVSAIRTPEGFNATDIVTLAAEKYGVAYGTGLGEVAGKVFRIGHLGSLT DVMALSGIATAEMVMADLGLDIQLGSGVAAAQDVYRSPQPTHSRAAA |
| 61 4 | MSFQNPVFIPGPTNIPESLRKACDMPTIDHRSPLFGQILHPARDGVRKVLKSETAEVFIFPSSGTGGWETA LSNTLSAGDTVLAARNGMFSHRWIDMCQRHGLDVQIVETPWGAGLPADRYEEILSADKDHKIKAVLATHN ETATGVKSDIAAVRRALDAAGHPALLFVDGVSSIASMDFRMDEWGVDVAVTGSQKGFMLSAGLAIVGFS PKAMEATKSAQLPRTFFDVHDMAKGYANNAYPYTPAVGLMNGLNESCKMLLAEGLENVFARHHRIAEGV RAAVGAWGLELCAATPEVYSDTVSAIRTPEGFNATDIVTHAADKYGIAFGVGLGEVAGKVFRIGHLGSLTD VMALSGIATAEMCMVDLGLDIRLGSGVAAAQEYYRGNAASAQQDAA |
| 61 5 | MSFQNPVFIPGPTNMPEALRRAADMPTLDHRSSLFAEILHPALDGVKQVLKSKTAEVFVFPSTGTGGWET ALTNTLSAGDKVLAARNGMFSHRWIDMCTRHGLDMQIVEAAWGAGVPTDRYEEILRADKNHEIKVVLAT HNETATGVKSDIAGVRRALDNAGHPALLYVDGVSSIGSMDFRMDEWGVDIAVTGSQKGFMLPAGLAIIGF SPKAMAQVETATLPRTFFDIRDMAAGYANNAYPYTPAVGLLNGLKLATEMLLNEGLENVFTRHNRIANGV RAAVNAWGLTLCAQSPDLYSDSVSAIMTPEGFNATDIVSHAADVYGVAFGVGLGEVAGKVFRIGHLGSLT DVMALSGIATAEMCMVDIGLDIQLGSGVAAAQEVYRQTTGYTLKAAA |
| 61 6 | MSNQNLVFIPGPTNIPDRLRLAMQVQTQDHRAPDFVETFAPVLEDTKKVFGTTTGQIVTFPSNGTGGWEA AVTNTLSPGDKVLVARYGVFSHRWIDLCERHGLDVQIVECPWGTGAPADQFQAALADDTAHEIRAVLVT HNETATGVRSDIAAVRQAMDSENHPAMLFVDCVSSLASMPFDFDAWGVDIAVSGSQKGFMLATGMAILC VSPKAQDAMKSAKLPRTFFDFDDMMAANASGGFPYTPPLQLIYGMRESLKMLFEEGLENVYARHFRLAE GVRRAVDAWGLKLVAQSRDLYSDTVSAIYVPDGYDSNTLTDHAFNAYGVSFGIGLGQLNGKAFRIGHLG SLTDVMVLSGLSTIEMAMADLNYPITLGSGVAAAQDYYRTGPSDRAQAAA |
| 61 7 | MISQNPVFIPGPTNMPEVLRKSCDMPTLDHRSAAFAGILHPALEGVKKVLKTTSAEVFVFPSTGTGGWET ALTNTLSPGDTVLVGRNGMFSHRWIDMCERHGLDVIVLDTAWGQGLPVDRYGEVLAQDTEHRIKAVLAT HNETATGVVSDIAGLRAAMDASDHPALLLVDGVSSIGSMNFEMDAWGVDIAVTGSQKGFMLPAGLAIVG VSQRALGAMATAKLPRTFFDLRDMQKGYAVNGYPYTPPVGLLNGLKLACDMLLEEGLENVFARHRRIAD GVRAAVAAWGLELCAERPEWQSDTVSAVRTPEGFDAGEIVTHAAEVYDMAFGVGMGEVAGKVFRIGHL GMLTEAQALCGLATVEMCMVDLGLDIQLGSGVAAAQGVYRHGTRQQAMAAE |
| 61 8 | MSFQNPVFIPGPTNIPENLRKACDMPTIDHRSPLFGTILHPARDGVRKVLKSDKAEVFIFPSTGTGGWETA VTNCLSSGDKVLAARNGMFSHRWIDLCQRHGLDVEIVEASWGAGIPVDRYEEILTADTSHQIKAVLATHN ETATGVKSDIAAVRKALDAAGHPALLFVDGVSSIGSMDFRFDEWAIDVAVTGSQKGFMLPPGLAIVGFSE KAMAATKTGTLPRTFFDVHDMAKGYANNAYPYTPAVGLLNGLTEACGMLMAEGLENVFARHTRIAEGVR AAVDAWGLELCAETPDVYSDTVSAIRTPEGFNATDIVTHAAETYGVAFGVGLGDVAGKVFRIGHLGSLTD VMTLSGLATAEMCMVDLGLDIKLGAGVAAAQEYYRAHTAFAQKAAA |
| 61 9 | MYMQNPVFIPGPTNMPEVLRKASDMPTLDHRSPLFGEILRPALAGVKKVLKTETASVFVFPSTGTGGWET AITNTLSPGDRVLAARYGMFSHRWIDMCQRHGLKVDVIESVWGGGAPADRYEEILTADTGHEIKAVLVTH NETATGVKSDIGAIRQAIDAAKHPALLFVDGVSSIASMDFRMDGWAVDIAITGSQKGFMLPAGLAIAAFSAK ALEALDSAKLPRTFFDVRDMTKSYANNAYPYTPAVGLLNGLKLSTELLLAEGLENVFARHRRIASGIRAAV RAWGLELCAKDEELYSDTVSAIRTPEGFDATSIVTHAARKYDVAFGVGLGEVAGKVFRIGHLGSLTDVMA LSGIATAEMVMVDLGLEITLGSGVAAAQDHYRNVHLSAVQAAA |
| 62 0 | MSFQNPVFIPGPTNIPESLRKACDMPTIDHRSPLFGQILHPARAGVRQILKSDNAEVFIFPSTGTGGWETA LTNTLSPGDKVLAARNGMFSHRWIDMCQRHGLSVQVVETTWGAGLPADRYEEILTADKNHEIKAVLATH NETATGVKSDIAAVRRALDASGHPAMLFIDGVSSIASMDFRFDEWGVDVAVTGSQKGFMLPAGLAIVGFS PKAMEATKTATLPRTFFDVHDMAKGYANNAYPYTPAVGLLNGLNQACDMLLREGLENVFARHHRIAEGV RAAVGAWGLDLCATDPSVYSDTVSAIRTPEGFNATDIVTHAANRYGVAFGVGLGEVAGKVFRIGHLGSLT DVMALSGIATAEMCMVDLGLNIELGSGVAAAQEYYRGHSAAAQKDAA |
| 62 1 | MSFQNPVFIPGPTNIPESLRKACDMPTIDHRSPLFGQILHPARAGVRQILKSDNAEVFIFPSTGTGGWETA LTNTLSPGDKVLAARNGMFSHRWIDMCQRHGLSVQVVETTWGAGLPADRYEEILTADKNHEIKAVLATH NETATGVKSDIAAVRRALDASGHPAMLFIDGVSSIASMDFRFDEWGVDVAVTGSQKGFMLPAGLAIVGFS PKAMEATKTATLPRTFFDVHDMAKGYANNAYPYTPAVGLLNGLNQACDMLLREGLENVFARHHRIAEGV RAAVGAWGLDLCATDPSVYSDTVSAIRTPEGFNATDIVTHAANRYGVAFGVGLGEVAGKVFRIGHLGSLT DVMALSGIATAEMCMVDLGLNIELGSGVAAAQEYYRGHSAAAQKDAA |

FIG. 12BD

| | |
|---|---|
| 622 | MSFQNPVFIPGPTNMPEALRRACDMPTLDHRSPLFGQILQPALAGVKKVLKTETAEVFLFPSTGTGGWET<br>AITNCLSPGDKILAARNGMFSHRWIDMCQRHGLKVEVVEAAWGTGLPADRYEEILAADTNHEIKAVLATH<br>NETATGVKSDIAAVRRALNAAKHPALLFVDGVSSIASMDFRMEEWGVDAAVTGSQKGFMLPPGLAIIALS<br>PKAQAAVESARLPRTFFDVRDMMKAYANNAYPYTPAVGLMNGLKQSCDMLLAEGLDNVFARHHRIAEG<br>VRAAVRAWGLELCAQTPDVYSDSVSAIRTPEGFNATGIVTHAAAKYGVAFGVGLGEVAGKVFRIGHLGSL<br>TDVMMLSGLATAEMVMADLGLDIQLGSGVAAAQEVYRSDSAIASKEAA |
| 623 | MSLQNPTFIPGPTNLPEVLRKACDMPTIDHRSPLFGDILRPARAGVQQVLKSRDAEILIFPSTGTGGWETA<br>LTNTLAPGDTVLAARNGMFSQRWVDMCQRHGLTVEIVETPWGEGIPADRFEEILSADKAHKIKAVLATHN<br>ETATGVRSDISAVRRAMDAAAHPALLFVDGVSSIGSMDFRFDDWGVDIAVSGSQKGFMLPAGLAILGLSP<br>KAMAAAETATLPRAFFDIRDMKRAYDNAAYPYTPLVGLLNGLNLSTKMLLDEGLDNVFARHRRIADGVRA<br>AVAAWGLPLCAATPDLYSDTVSAVRTPEGVDATEIVRRAAADYGVAFGVGLGQLSGKAFRIGHLGSLTDV<br>MMLSGLATLEMCMADLGLDIRPGSGVAAAQDVYRKSQTPQAREAAE |
| 624 | MSFQNPVFIPGPTNMPEALRKAVDMPTLDHRSPLFGQILHPALAGVKKVLKSESAEIFVFPSTGTGGWET<br>SITNTLNAGDKILAARNGMFSHRWIDMCQRHGLDVQVVETPWGEGLPADRYEEILTADKNHEIKAVLATH<br>NETATGVKSDIAAVRRALDAAGHPALLFVDGVSSIASMDFRMDEWDVDIAVTGSQKGFMLPPGLAIVGFS<br>PKAMKASGTATLPRTFFDIKDMANGYAANAYPYTPSVGLLNGLNMACGMLLDEGLENVFARHHRIAEGV<br>RAAVRAWGLELCAASPEVYSNSVSAIRTPEGFDANRFVSLAAEKYGVAFGTGLGEVAGKVFRIGHLGSLT<br>DVMALSGIATAEMVMADLGLDIPLGSGVAAAQDYYRGHEVSASKVAA |
| 625 | MSFQNPVFIPGPTNMPEEIRLACHMPTIDHRSPIFGGILHPCLDGVRRVLKSEKAHIYIFPSTGTGGWETTL<br>TNTLSVGDKVLVARNGMFSHRWIDMCERHGLDVQIVEAAWGDGLPVAEYEAILKADTGHSIKAVLATHNE<br>TATGVKSDIAGVRKALDAAAHPALFFVDGVSSIGSMDFRMDDWGIDVAVTGSQKGFMLPAGLAIVGFSDK<br>ARAAVEIATLPRTFFDIRDMEKGYAANAFPYTPPVGLMNGLKHSLEMIEAEGLENVFARHTRIATGVRHAV<br>DAWGLELCANAPELYSDSVSAIRTPEGFNATDIVTRADEQYGMAFGVGLGEVAGKVFRIGHLGMLTDAM<br>MLSGLGVAEMVMKDLGFDIKLGSGVGAAQEFYRFGA |
| 626 | MSTQNPIFIPGPTNIPEVLRKAVDMPTIDHRSPLFGNILHPALEGVKAILKTSKAEVFVFPSTGTGGWETAIT<br>NTLSAGDKVLATRNGMFSHRWIDMCQRHGLDVQVVMQEWGDGVPADTFEEILTADKGHEIKVVLATHN<br>ETATGVRSDIAAVRRALDNAKHPALLFVDGVSSIACYDFRMDEWGVDVAVTGSQKGFMLPPGLAILGFSQ<br>KALAATGSARLPRTFFDVRDMAKGYASNGYPYTPPVGLLNGLKVATDMLLDEGLENVFARHHRIAEGVR<br>RAVSAWGLELCAARPELYSDSVSAIRTPEGFDANKIVAHALNTYGVAFGTGLGDVAGKVFRIGHLGSLTD<br>VMALSGIATAEMVMADLGLPVTLGSSVAAAQQSYRQSAGNAQRKAT |
| 627 | MTSQNPIFIPGPTNIPEEMRKAVDMPTIDHRSPVFGRMLHPALEGVKKVLKSTQAEVFLFPSTGTGGWET<br>AITNTLSPGDKVLAARNGMFSHRWIDMCQRHGLDVTFVETPWGEGIPADRFEEILTADKGHEIRVVLATH<br>NETATGVKSDIAAVRRALDNAKHPALLFVDGVSSIGSMDFRMDEWGVDIAVTGSQKGFMLPPGLAIVGFS<br>PKAMAAVETARLPRTFFDIRDMAQGYARNGYPYTPPVGLINGLNASCERLLSEGLENVFARHHRIAGGVR<br>AAVEAWGLKLCAVRPELYSDSVSAIRVPEGFDANLIVSHALETYDMAFGTGLGQVAGKVFRIGHLGSLTD<br>AMALSGIAVAEMVMADLGLPIKLGSGVAAAQEHYRQTTATALKKAA |
| 628 | MSFQNPVFIPGPTNMPEVLRKAVDMPTLDHRSPLFGQILHPALAGVKKVLKSETAEIFVFPSTGTGGWET<br>ALTNTLSAGDKILAARNGMFSHRWIDMCQRHGLNVQVVETPWGEGLPADRYEEILTADTSHEIKAVLATH<br>NETATGVKSDIAAVRRALDAAGHPALLFVDGVSSIASMDFRMDEWGVDIAVTGSQKGFMLPPGLAIVGFS<br>PKAMKAAETATLPRTFFDIKDMAAGYANSAYPYTPSVGLLNGLNMACGMLLDEGLENVFARHHRIAEGV<br>RAAVRAWGLELCAVSPDVYSDSVSAIRTPEGFDANKFVSLAAEKYGVAFGTGLGEVAGKVFRIGHLGSLT<br>DVMALSGIATAEMVMADLGLNIQLGSGVAAAQDYYRGNTGASAKAAA |
| 629 | MSFQNPVFIPGPTNIPEFLRKACDMPTIDHRSPLFGQILHPARDGVRKVLKSETAEVFIFPSTGTGGWETA<br>LTNTLSPGDKVLAARNGMFSHRWIDMCQRHGLSVEIVETPWGHGLPSDRYEEILTADTGHRIKAVLATHN<br>ETATGVKSDIAAVRRALDAAGHPALLFVDGVSSIASMDFRFDEWGVDVAVAGSQKGFMLTAGLAILGFSA<br>KAMAATKTAQLPRTFFDVHDMANGYAKNAYPYTPAVGLLNGLNESCRMLLDEGLENVFARHTRIAEGVR<br>RAVDAWGLELCAASPEVWSDTVSAIRTPEGFNATEIVTHAANTYGVAFGVGLGEVAGKVFRIGHLGSLTD<br>VMTLSGIATAEMCMADLGLDITLGSGVAAAQDYYRGHPAAALKSAA |
| 630 | MSLQNPIFIPGPTNIPDRLRRAMNVPTQDHRAPDFSDTFLPVLADCKKVFGTQDGEIILFTSSGTGGWEAA<br>ISNTLSPGDKVLIARYGMFSHRWIDMCQRHGLDVQVVECDWGTGAPADKFQAILNEDTAHEIKAVMVTH<br>NETATGVLSDIGAVRKAMDSSDHPALLFVDGVSSIACVPFEMDAWGVDVAVAGSQKGFMLATGMAILGV<br>SQKALSHMDEAKLPRTYFAFRDMLNANANGGFPYTPPLNLIYGLRESLEMLFDEGLDNVYARHYRLAEG<br>VRQAVSAWGMKLCAKTPDLYSNTVSAIFVPEGFDSNKLTDHAFNKYGISFGIGLGEMNGKAFRIGHLGSL<br>TEVMVLAGLATIEMAMVDLGYPIKLGQGVAAAQEYYRHSAPTK |
| 631 | MYLQNPVFIPGPTNMPEVLRKASDMPTIDHRSPLFGEILRPALAGVKKVVKSQTASICLFPATGTGGWETA<br>ITNTLSPGDRVLVARYGMFSHRWIDMCQRHGLDVSVIETPWGSGAPVDRYEEMLTADKAHQIKAVLVTH<br>NETATGVKSDIAAVRRALDAARHPAMLFVDGVSSIASMEFRMDDWGVDVAVTGSQKGFMLPAGLAITAF<br>SPKALAALETAKLPRTFFDVRDMSKSYENNAYPYTPAVGLLNGLKVSTEMLLAEGLENVFARHNRIATGIR<br>AAVRAWGLELCAMSEDLYSDTVSAIRTPDGFDATSIVTHAAKKYDVAFGVGLGEVAGKVFRIGHLGSLTD<br>VMALSGIATAEMVMADLGLSIKLGSGVAAAQDYYRNNQVSAGRGAA |

FIG. 12BE

| | |
|---|---|
| 632 | MSDQNPVFIPGPTNIPDRLRRAMQVQTQDHRSPAFVNTLTPVLKGCKTVFGTTNGEIITFPASGTGGWEAAITNTLSPGDKVLVARYGMFSHRWIDMCQRHGLDVQIIECPWGGGAPADRFKEALTADKDHSIKAVLVTHNETATGVRSDIAAVRGAMKSAKHPALLMVDCVSSLGSMPFEMDKWGVDIAVSGSQKGFMLNTGMAILAVSPRALAMMDTAQLPRTFFDFRDMMGANAKGGFPYTPPLQLIYGMAESLNMLFEEGLDNVYARHTRIAEGVRRAVAAWGLKLVAQSPELYSDTVSAVFVPEGFDSNRLTERVFATYGMSFGVGLGEMNGRAFRIGHLGSLTESMMLSGLATLEMAMADLNYPVKLGSGVIAAQEYYRSTAKPILAEKAA |
| 633 | MYMQNPVFIPGPTNMPEVLRKATDMPTLDHRSPLFGEILRPALAGVKKILKTEAASVYVFPSTGTGGWETAITNTLSPGDRILAARHGMFSQRWIDMCQRHGLKVDIVEVAWGAGAPADRYEEILAADTAHEIKAVLVTHNETATGVKSDIAAVRQAIDAAKHPALLFVDGVSSIASMDFRMDEWSVDIAITGSQKGFMLPAGLAITAFSPKALAAVETAKLPRTFFDIRDMARSYANNAYPYTPAVGLLNGLKLSTELLLAEGLENVFARHRRIASGIRAAVRAWGLELCAKSEDLYSDTVSAIRTPEGFDATSIVAYAAKTYDVAFGVGLGEVAGKVFRIGHLGSLTDVMALSGIATAEMVMVDLGLNIKLGSGVAAAQDYYRAGRASKVQAAA |
| 634 | MYMQNPVFIPGPTNMPEILRKAADMPTLDHRSPLFGEILRPALAGVKKILKTEAASVYVFPSTGTGGWETAITNTLSPGDRVLAARYGMFSQRWIDMCQRHGLKVDIIEAAWGGGAPAARYEEILAADTAHEIKAVLVTHNETATGVKSDIAAVRRAIDAARHPALLFVDGVSSIASMDFRMDEWSVDIAVTGSQKGFMLPAGLAITAFSPKALAAVETAKLPRTFFNIGDMARSYANNAYPYTPAVGLLNGLKLSTELLLAEGLENVFARHRRIASGIRAAVRAWGLELCAMSEDLYSDTVSAIRTPEGFDATSIVAHAAKTYDVAFGVGLGEVAGKVFRIGHLGSLTDVMALSGIATAEMVMVDLGLDIKLGSGVAAAQDYYRDGRASKVRAAA |
| 635 | MFAQNPVFIPGPTNMPEVLRRAADMPTLDHRSPLFAQILHPALAGVKKVLKSEDAEVFIFPSTATGGWETALSNTLSAGDTVLAARHGMFSHRWIDMTRRHGLDVRMIEAPWGEGLPADRFAEALAADKAHRIRAVLVTHNETATGVRSDVAAVRRALDASNHPALLLVDGVSSIASMDFRMDEWGVDVAVTGSQKGFMLPAGLAIVAFSPKAMAATATATLPRTYFDIRDMAKGYPNGAYPYTPAVGLLNGLKLSTELLLAEGLETVFARHRRIADGIRAAVAAWGLELCAARPDLYSDTVSAIRTPEGFDATRIVTHAARHYDVAFGVGLGEVAGKVFRIGHLGSLTDVMALSGIAAAEMAMADLGLRIALGSGVAAAQAVYRRAPAAALRAAA |
| 636 | MSGYNHLFIPGPTNIPERVRQAMNLPMEDMRSPRYPELTLPLFADIKQVFKNKTGRVFIYPSSGTGAWEAAMTNVLSPGDRVLMSRFGQFSHLWVDMAERLGFEVDCLDREWGTGVPVELYAERLAADEAHEIKAVFVTHNETATGVTSDVAAVRAALDACGHPALLFVDGVSSIGSIDFRQDEWGVDCAVSGSQKGFMMPAGLGFLSVSQKALEAARTARHIRCYFSFEDMIKTNDTGYFPYTPPTQLLRGLRAALDLIFEEGLETIFARHHHLANGVRAAVSAWGLKLCATEPKWHSDTVSAIRLPEGIDGVEVIRHAYQAYNTSLGSGLSKVAGKVFRIGHLGSLNEVMVLGALSAAELTLLDCGVKIEPGAGVGAAISQFRSAAVSSAKAA |
| 637 | MYLQNPVFIPGPTNMPEVLRKASDMPTIDHRSPLFGEILRPALAGVRKVVKSDAASIFVFPATGTGGWETAITNTLSPGDRVLVARYGMFSHRWIDMCQRHGLDVSVIETPWGSGAPVHRYEELLTADKAHQIKAVLVTHNETATGVKSDIAAVRHALDSARHPAMLFVDGVSSIASMEFRMDDWGVDVAVTGSQKGFMLPAGLAITAFSTKALAAVETAKLPRTFFDVRDMSKSYENNAYPYTPAVGLLNGLKLSTEMLLAEGLENVFARHNRIATGVRAAVRAWGLELCASSEDLYSDTVSAIRTPDGFDATSIVTHAAKKYDVAFGVGLGEVAGKVFRIGHLGSLTDVMALSGIATAEMVMADLGLGIKLGSGVAAAQEYYRKNQVPADRGAA |
| 638 | MSFQNPVFIPGPTNIPERLRKACDMPTIDHRSPLFGQILHPAREGVRKVLKSNSAQVFIFPSTGTGGWEAALTNCLSAGDKVLAARNGMFSHRWIDMCQRHGLKVEIIETPWGHGVPADRYEEILAADENHEIKVVLATHNETATGVKSDIAAVRRALDAAGHPAMLFVDGVSSIASMDFRFDEWGVDVAVAGSQKGFMLAPGLAITAFSDKAMMATEAATLPRTFFDVKDMAKGYANNAYPYTPAVGLLNGLNEACGMLLDEGLENVFARHHRIAEGIRAAVGAWGLELCAVSPEVYSDTVSAIRTPEGFNATDIVSHAASAYGVAFGTGLGEVAGKVFRIGHLGSLTDVMALSGIATAEMVMADLGLDITLGSGVAAAQDCYRGNRLNADKAAA |
| 639 | MTSQNPIFIPGPTNIPEEMRKAVDMPTIDHRSPVFGRMLHPALEGVKKVLKTTQAQVFLFPSTGTGGWETAISNTLSPGDKVLAARNGMFSHRWIDMCQRHGLDVTYVETQWGEGIPADRFEEILTADKGHEIRAVLATHNETATGVKSDIAAVRRALDAAQHPALLLVDGVSSIGSMDFRMDEWGVDVAVTGSQKGFMLPPGLAIVGFSPKAMEAVESARLPRTFFDIRDMATGYARNGYPYTPPVGLINGLNLSCERLLSEGLENVFARHHRIASGVRAAVEAWGLKLCAVRPELYSDSVSAIRVPEGFDANLIVSHALETYDMAFGTGLGQVAGKVFRIGHLGSLTDAMALSGIATAEMVMADLGLPIKLGSGVAAAQDHYRRTTAAAQKKAA |
| 640 | MSFQNPVFIPGPTNIPESLRKACDMPTIDHRSPLFGQILHPAREGVRHVLKSASAEVFIFPSTGTGGWETALTNTLSPGDTVLAARNGMFSHRWIDMCQRHGLTVEVVETPWGEGLPAQRYAEILAADKSRRIKAVLATHNETATGVRSDIAAVRRALDEADHPALLFVDGVSSIASMDFRFDDWGVDCAVTGSQKGFMLPPGLAIVGFSEKAMAATKTAKLPRTFFDVTDMAKGYANNAYPYTPAVGLLNGLNESCRMLLDEGLENVFARHHRIAEGVRAAVRAWGLELCAASPEVYSDTVSAIRTPEGFNATDIVSHAAQTYGVAFGTGLGEVAGKVFRIGHLGSLTDVMTLSGLACAEMCMKDLGLDIALGSGVAAAQDFYRANPALARKEAA |
| 641 | MNLQNPVFIPGPTNIPEALRKACDMPTIDHRSAVFGEILHPLRAKLREVLKSESAEIFLFPATGTGGWETALTNTLSPGDKVLAARNGMFSHRWIDMCQRHGLDVHVVEVPWGEGIPAERLGGILAADAGHSFKAVLATHNETATGVQSDIGALRRAMDAAGHPAMLFVDGVSSIASMEFRFDDWGVDVAVTGSQKGFMLPAGLAITAFSPKAVAASVTAGLPRTFFDIRDMDKGYAQGGYPYTPPVGLINGLNAACDMLLAEGMEDVFARHARIANGVRAAVRAWGLELCAATPDVWSDTVSAIRTPPGVNATDIVTHAADAYGTAFGTGLGEVAGKVFRIGHLGSLTDVMALSGIATAEMCMADLGMKIELGSGVAAAQEVYRATHARKQKDAA |

FIG. 12BF

| | |
|---|---|
| 642 | MNFQNPVFIPGPTNMPEAIRQACYMPTIDHRSPVFGKILNPCLEGVRKVLKSDSARIFIFPSTGTGGWETA LTNTLSPGDGILAARNGMFSHRWIDMCQRHGLDVTVVETPWGEGLPAENYEEVLKADKDHRIKAVLATH NETATGVKSDIAAVRRALDAARHPALLFVDGVSSIGSMDFRFDDWGVDVAVTGSQKGFMLPAGLAIVGF SDKAMKATETAKLPRTFFDVRDMGKYDNNAFPYTPPVGLMNGLKLSLDMLLDEGLENVFARHHRIAEG VRRAVRAWGLELCAVSPDLYSDTVSAIRTPEGFNATDIVTVAARDYDMAFGVGLGEVAGKVFRIGHLGSL TDAMMLSGLGVAEMVMVDLGLDVKLGSGVSAAQEFYRHGGTARKAAA |
| 643 | MYGQNPVFIPGPTNMPEILRKAADMPTMDHRSSMFGEILHPALTGVKQVLKTETASVFIFPATGSGGWET AITNTLSPGDRVVAGRHGMFSQKWIDMCRRHQLKVDAIECSWHDGVPLAQYEEFLNADKAHEIKAVLVT HNETATGVKSDVAAVRRLLNAANHPALLLVDGVSSIASMDFRMDEWGVDVAVTGSQKGFMLPVGLAITA FSPKAIAALDTAKLPRAFFDVRDMAKGYSTNGYPYTPSVGLLNGLKVSTELLLQEGLENVFARHRRIASGV RAAVRAWRLELYAAREELYSDTVTAVQTPAGFDASRFVTHAATKYDVAFGAGLGDVAGKVFRIGHVGSM TDVMALSGIATAEMVMVDLGLNIKLGSGVAAAQAIYRNSHTSAVEMVA |
| 644 | MPGFSHLYIPGPTNLPEAVRRAMNVPMEDMRAPDFPDLTRPVFEKAQKVFRNSEGRVFIYPSSGTGAWE AAIQNTLSPGDKVLMSRFGQFSNLWVDMAQRMGLDVDVIDCEWGEGVPVDQYAERLKADKTHDYKAVF ATHNETATGVTSDIKGVREALDAAGHPALLMVDGVSSVGSIEFDQDAWGVDCAVSGSQKGFMLPAGLGI LSVSKWALEAHKTAEFPRCYFSFEDQIRMNDTGYFPYTPATQLLRGLDVSCDMLLDEGLENVWARHRRL ASGVRAAVEAWGLTLCAARPELWSDTVSAIVVPDDRDARDVIAAAYAKYDTSLGSGLANVAGKVFRIGHL GWLNEGMVCTALSAAEMAMIECGFEIEAGSGVGAAIRLFATSDAPQMKIAAE |
| 645 | MSFQNPVFIPGPTNIPERLRKACDMPTIDHRSPLFGQILHPAREGVQKVLKSDSAEVFIFPSTGTGGWETA LSNTLSPGDKVLAARNGMFSHRWIDMCQRHDLDVTIVETPWGEGLPAARYEEVLAADTGHEIKAVLATH NETATGVKSDIAAVRRALDTAGHPAMLFVDGVSSIGSMDFRFDEWGVDVAVTGSQKGFMLSAGLAIVGF SDKAMQATKTARLPRTFFDVHDMAKGYANSAYPYTPAVGLLNGLNEACGMLLSEGLDNVFARHTRIAEG VRAAVGAWGLDLCATAPEFYSDTVSAIRTPEGFDATRVVTHAADVYGVAFGVGLGEVAGKVFRIGHLGS LTDVMTLSGIATAEMCMVDLGLDIELGSGVAAAQRIYRADAALARKDAA |
| 646 | MSTQNPIFIPGPTNIPEVLRKAVDMPTIDHRSPLFGNILHPALEGVKAILKTSKAEVFVFPSTGTGGWETAIT NTLSAGDKVLATRNGMFSHRWIDMCQRHGLDVQVVMQEWGEGVPADTFEEILTADKGHEIKVVLATHN ETATGVRSDIAAVRRALDNAKHPALLFVDGVSSIACYDFRMDEWGVDVAVTGSQKGFMLPPGLAIVGFS QKALAATGSARLPRTFFDVRDMAKGYAANGYPYTPPVGLLNGLKVATDMLLDEGLENVFARHHRIAEGV RCAVSAWGLKLCAARSDLYSNSVSAIRTPEGFDANKIVAHALNTYGVAFGTGLGDVAGKVFRIGHLGSLT DVMALSGIATAEMVMADLGLPVNLGSGVAAAQQSYRQSAGIAQRKAA |
| 647 | MSFQNPVFIPGPTNMPEALRKAVDMPTLDHRSPLFGQILHPALAGVKKVLKSETAEIFVFPSTGTGGWET AITNTLNSGDKILAARNGMFSHRWIDMCQRHGLDVQVVETPWGEGLPADRYEEILTADTSHQIKAVLATH NETATGVKSDIAAVRRALDAAGHPALLFVDGVSSIASMDFRMDEWGVDIAVTGSQKGFMLPPGLAIVGFS PKAMKAAETATLPRTFFDIKDMANGYANSAYPYTPSVGLLNGLNMACGMLLDEGLENVFARHHRIAEGV RAAVRAWGLELCAVSPDVYSDSVSAIRTPDGFDANKFVSLAAEKYGVAFGTGLGEVAGKVFRIGHLGSLT DVMALSGIATAEMVMADLGLNIQLGSGVAAAQDYYRGNTASSTKAAA |
| 648 | MFAQNPVFIPGPTNMPEVLRRAADMPTLDHRSPLFAQILHPALAGVKTVLKSQDAEVFVFPSTATGGWET ALSNTLSAGDAVLAARHGMFSHRWIDMTRRHGLDVRVIEAPWGEGLPADRFAEALAADTAHRIRAVLVT HNETATGVRSDVAAVRRALDASGHPALLLVDGVSSIASMDFRMDEWGVDVAVTGSQKGFMLPAGLAIVA FSPRAMAATATATLPRTYFDVRDMAKGYPNGAYPYTPAVGLLNGLKLSTELLLAEGLDNVFARHRRIADG IRAAVAAWGLELCAARPDLYSDTVSAICAPEGFDATRIVTHAARHYDVAFGVGLGEVAGKVFRIGHLGSLT DVMALSGIAAAEMAMADLGLRIELGSGVAAAQAVYRRAPAAGLRAAA |
| 649 | MSFQNPVFIPGPTNMPEAVRQACYMPTIDHRSPTFGKILHPCLDGVRQVLKSKDAKIFIFPSTGTGGWET ALSNTLNKGDKVLAARNGMFSHRWIDMCQRHGLDVHIVETPWGEGVPAGKYEEILKADKNHEIKVVLAT HNETATGVKSDIAAVRKALDAAGHPAMLFVDGVSSIASMDFRFDEWGVDIAITGSQKGFMLPAGLAIIGFS SKAIAASANATLPRTFFDIKDMQKGYDANAFPYTPPVGLMNGLKLSLDMLLDEGLENVFARHHRIAEGVR KAVSAWGLELCAASPDLYSDTVSAIRTPEGFNATDIVTHAADKYDVAFGVGLGEVAGKVFRIGHLGSLTD VMTLSGLATAEMCMVDLGLDVKLGSGVAAAQEYYRTNPAAGK |
| 650 | MSFQNPVFIPGPTNMPEAVRQACYMPTIDHRSPTFGKILHPCLDGVRKVLKSKDAKIFIFPSTGTGGWETA LSNTLSKGDKVLAARNGMFSHRWIDMCQRHGLDVHVVETPWGEVPTDKYEEVLKADKNHEIKVVLATH NETATGVKSDIAAVRKALDAAGHPAMLFVDGVSSIASMDFRFDEWGVDIAITGSQKGFMLPAGLAIIGFSG KAIAAAENSDLPTTFFDIGDMQKGYNANAFPYTPPVGLMNGLKLSLDMLLDEGLENVFARHHRIAEGVRA AVSAWGLELCAASPDLYSDTVSAIRTPEGFNATDIVTLAAEKYGVAFGVGLGEVAGKVFRIGHLGSLTDV MMLSGLATAEMCMVDLGLDVKLGSGVAAAQEYYRTNPTAGK |
| 651 | MSTQNPVFIPGPTNIPERLLSAMHVQTRDHRAPDFVETFAPVLNDTKRVFGTKDGTVITFPASGTGGWEA AVTNTLSPGDKVLVARYGMFSHRWIDLCQRHGLDVQIIECPWGAGAPADKFESVLSEDKGHEIKAVLVTH NETATGVKSDIAAVRGAMDAASHPAMLFVDCVSSLASMPFEMDAWGVDIAVSGSQKGFMLATGMAILGV SPKALDAMEAAKLPRTFFDFRDMTKANASGGFPYTPPLQLIYGLRESLKMLFEEGLENVYDRHFRLAEGV RRATKAWGLDLVAQSPDLYSDTVSAIYVPKGFDSNALTQHAFDAYGVSFGIGLGEMNGKAFRIGHLGSLT DVMVLSGLGAIEMAMADLNYPITLGSSVAAAQEYYRSTHAPAVRSAA |

FIG. 12BG

| 652 | MHASNPIFLPGPTNLPEPLRRACDIPTMDHRSAAFGPILAAAKEGVARILGLSGGEVALFPATGTGGWEA AVTNALRPGDKVLAARHGMFSRKWIDLCQRHGLEVEIVERPWGEGVPVEEFAAALAADGGHQIRAVLVT HNETATGVTSDVAAVRAAMDAAGHPALLMVDGVSSIGSIEFRMDDWGVDLAVAGSQKGFMLPAGLAIIGI SAKARQAMETAGLPRCFFDIRDMEDGNYPYTPPVGLINGLAVSTGLLLEEGMENVRARHHRIAEGVRRA VAAWDMTTCAAAPELCSDTVTAIVTPEGFDAGRIVRHAAEAYGVAFGGGLGEVAGKVFRIGHLGLMSDV MALSGIATAEMAMVDLGLPVRLGSGVAAAQEHYRNSRTAPVQAAA |
| --- | --- |
| 653 | MSDQNPVFIPGPTNIPDRLRAAMQVQTRDHRAPDFVDTFAPVLQDTKKVFGTTSGRVITFPASGTGGWE AALCNTLSPGDKVLVARYGMFSHRWIDMCERHGLDVQVIECPWGTGAPADKFEASLSDDKSHAIKAVLV THNETATGVKSDVAGVRAAMDASAHPALLFVDCVSSLASMPFEMDAWGVDIAVSGSQKGFMLATGMAIL GVSEKALAAMQTASLPRTFFDFRDMMGANASGGFPYTPPLQLIYGMRESLKMLFEEGLDNVYARHTRLA EGVRCAVKAWGLELVAQNPSLYSDTVSAIYVPEGFDSNALTDQAFNQYGVSFGVGLGEMNGKAFRIGHL GSLTDVMVLSGLATIEMAMADLDYPIELGSGVAAAQEHFRSKSGAAIKSAA |
| 654 | MSFQNPVFIPGPTNMPEALRKAVDMPTLDHRSPLFGQILHPALAGVKKVLKSENAEIFVFPSTGTGGWET AITNTLSADDKVLAARNGMFSHRWIDMCQRHGLDVQIVETPWGEGLPADRYEEILTADTAHEIKVVLATH NETATGVKSDIAAVRRALDAAGHPALLFVDGVSSIASMDFRMDEWGVDIAVTGSQKGFMLPPGLAIVGFS PKAMQAVEAATLPRTFFDIKDMALGYSNSAYPYTPSVGLLNGLNMACGMLLDEGLENVFARHYRIAEGV RAAVRAWGLELCAVSPDVYSDSVSAIRTPDGFDANKFVSLAAEKYGVAFGTGLGEVAGKVFRIGHLGSLT DVMALSGIATAEMVMADLGLNIQLGSGVAAAQDYYRGNQASSTKAAA |
| 655 | MSFQNPVFIPGPTNIPESLRKACDMPTIDHRSPLFGTILHPARKAVQAILKSTSAEVFIFPSTGTGGWETAIT NTLSEGDTVLVARNGMFSHRWIDMCERHGLELIIVDVAWGQGIPADRFEEILTGDTAHRIKAVLATHNETA TGVVSDIGAIRHAMDAAGHPAMLMVDGVSSIASMDFRFDAWGVDVAVTGSQKGFMLPPGLAIVGFSEKA MDATKTAGLHRTFFDVHDMMKGYANSAYPYTPAVGLMNGLNEACRMLMDEGLETVFARHHRIAEGVRR AVWAWGLELCAESPDVYSDTISAVRTPNGFNATDIVTHAASTYGVAFGVGLGDVAGKVFRIGHLGSLTEV MTLSGIATAEMCMVDLGLDIKLGSGVAAAQEYYRYGSEIEQKVAAQ |
| 656 | MSFQNPVFIPGPTNMPEALRKACDMPTLDHRSPLFGEILRPVLAGVKKILKTETAEVFIFPSTGTGGWETV LTNTLSADDKILAARNGMFSHRWIDMCQRHGLKVEVVETPWGAGLPADRYEEILTADTNHEIKAVLATHN ETATGVKSNIAAVRRALSAAKHPALLLVDGVSSIASMDFRMDEWGVDAAVTGSQKGFMLPAGLAIVALSP KAQAAIETAKLPRTFFDVRDMMKAYATNAYPYTPAVGLLNGLKTSCDMLLGEGLENVFTRHHRIAEGVRS AVRAWGLELCAKTPDVYSDTVSAIYTPEGFNATDIVTHAAGKYGVAFGVGLGEVAGKAFRIGHLGSLTDV MTLSGLATAEMVMVDLGLDIKLGSGVAAAQEYYRNEEALASKEAA |
| 657 | MSFQNPVFIPGPTNMPEALRRAVDMPTLDHRSSLFAEMLHPARAGVKKVLKSETAEVFFFPSTGTGGWE TALTNTLSPGDTILAARNGMFSHRWIDMCQRHGLNVQVVETEWGLGLPADRFEEILSSDTSHQIKVVLAT HNETATGVKSDIAAVRKALDAAGHPAMLYVDGVSSIASMDFRMDEWGVDIAVTGSQKGFMLPAGLAIVG FSPKAMQMVEAATLPRTFFDIRDMGRSYAANGYPYTPAVGLLNGLNKSCDMLLAEGLENVFARHHRIAS GVRAAVHAWGMELCAASPDLYSDSVSAIRTPDGFDATQFVTHAADTYGVAFGVGLGDVAGKVFRIGHLG MLTDVMALSGIATAEMCMADLGLDIRLGSGVAAAQEVYRGSTAKPLKEAA |
| 658 | MNLQNPVFIPGPTNIPEALRKACDMPTIDHRSAVFGEILHPLRAKLREVLKSESAEIFLFPATGTGGWETAL TNTLSPGDKVLAARNGMFSHRWIDMCQRHGLDVHVVEVPWGEGIPAERLGGILAADAGHSFKAVLATHN ETATGVQSDIGALRRAMDAAGHPAMLFVDGVSSIASMEFRFDDWGVDVAVTGSQKGFMLPAGLAITAFS PKAVAASVTAGLPRTFFDIRDMDKGYAQGGYPYTPPVGLINGLNAACDMLLAEGMEDVFARHARIANGV RAAVRAWGLELCAATPDVWSDTVSAIRTPPGVNATDIVTHAADAYGTAFGTGLGEVAGKVFRIGHLGSLT DVMALSGIATAEMCMADLGMKIELGSGVAAAQEVYRATHARKQKDAA |
| 659 | MRTSQNPVFIPGPTNMPEHLRKAADMATLDHRGPAFAGMLKPALEGVKTILGTTDGEVILFPATGTGGW EEAVSNTLSPGDTVLAARFGMFSHRWIDLCQRHGLNVQIIETPWGEGAPIAAIEEALTNDKEHRIKAVLAT HNETATGVKSDIAAVRGAMDAAGHPAMFFVDGVSSIASMPFHMDDWGVDVAITGSQKGFMLPAGLAICG ISPKAVAAMETAKLPRTFFDFRDMRDSMAGGGFPYTPPVGLIHGLSVAVEDLLTEGLDNVYARHTRIATG VRAAIEAWGMTPYAKTPDLFSDTVTAVKVPDGFNGTDVVTRAASEYDMAFGVGLGEVAGKVFRIGHLGQ LTDAMMLSGLSVAEMCMADLGYPIELGSGVAAAQSVYRHGDNVLALAAE |
| 660 | MSFQNPVFIPGPTNIPESLRKACDMPTIDHRSPLFGQILHPARERVRRVLKSASAEVFIFPSTGTGGWETA LTNTLSPGDTVLAARNGMFSHRWIDMCQRHGLTVEVVETAWGEGLPADRYAEILAADKSRRIKAVLATH NETATGVRSDIAAVRRALDDVDHPALLFVDGVSSIASMDFRFDDWGVDVAVTGSQKGFMLPPGLAITGFS EKAMAATQTAKLPRTFFDVHDMAKGYANDAYPYTPAVGLLNGLNEACRMLLDEGLENVFARHHRIAEGV RAAVGAWGLELCAASPDLYSDTVSAIRTPEGFNATDIVSHAAQTYGVAFGTGLGEVAGKVFRIGHLGSLT DVMALSGLATAEMCMKDLGLKITLGSGVAAAQEVYRTSTATARTASQEAA |
| 661 | MNGQNPIFIPGPTNIPDRLRAAMNVQSSDHRAPDFKEIFLPVLADVKKIFKMSGGEVIIFPASGTGGWEAS VTNTLSPGDKVLVARYGMFSHRWIDLCQRQGLDVEIIECAWGSAAPADLFAQRLAADPEGRIKAVLVTHN ETATGVRSDIAGVRKAMNASDHAALLFVDCVSSLGCMDFRMDEWGVDLAVAGSQKGFMLNTGMAIVGV SDKALAAMDSARCPRCFFDFRDMLAANQKGGYPYTPPLQLIHGLRASVDMLLEEGLDAVFARHFRLAEG VRQAVAAWGLTLCAQSADLYSDTVSAIYVPEGLNSDALTDHAYHTYDVSFGVGLGEMAGKAFRIGHLGS LSDLMVLSGLAGIEMAMKDLDYPIELGSGVAAAQAYYRKTAAGNTQ |

FIG. 12BH

| | |
|---|---|
| 62 | MSFQNPVFIPGPTNIPESLRKSCDMPTIDHRSPLFGGILNAARDGVRQVLKSATAEVFIFPATGTGGWETALTNTLSPGDTVLAARNGMFSHRWIDMCQRLGLTVRVVETPWGQGIPHDQFAEILAADTSHEIKAVLATHNETATGVTSDIAAVRAAMDGSDHPAMLFVDGVSSIGSIDFQFDDWGVDVAVTGSQKGFMLPAGLAIVGFSAKAMAAQPSAQLPRTFFDIRDMADGYAAGAYPYTPAVGLMNGLSHACTMLLSEGLDTVFARHHRIASGVRAAVSAWGLELCAASPDLYSDTVSAIRTPAGFDASRIVSHAATTYGVAFGGGLGEVAGKVFRIGHLGSLTDVMALSGIATAEMCMADHGLDITLGSGVAAAQDVYRAHGAANVQKDAA |
| 66 | MATEKRKRGRPKSFADKSEQNTNQSLDRAIDILECLASARGLALSEVAERLDLAPATVYRALHTFESRRLTEIDPETQTWHIGPDLFRLGSAFLLRSSLVERARPVLRKLMEVTGETANIGIERDGEILFLSQVETQSNIRAFFQPGTRAPLHASGIGKALLSQYDRARIDRLLPEMRLEQFTMKTRFDKEQLLSELDLIHRRGWALDDEERTHGMRCVAAPITDFTGEAIGGISVSGPSDRMPDARLTEIGNIVRDAALDLSRRLGAPLSVSIRPSTDEA |
| 67 | MDSQENASRATRRARGRPRDWHDKTAQNTIKSLDRAMEVFEYLSQAQGKPLTMIAEEMGQSPATVYRILVTLEGRGLVDFDAEEQLWHIGAQAFVIGARFLRRTSLVDRARPILRRLMEDTGETANLGVEKEGHVLFLSQVETHASIRAFFPPGTLSQMHASGIGKALLAEMDGSRLDRLLAATRLEIFTDHTITDPEALKADLAAIRAQGFAVDNEEKNAGMRCIAAPVFDMNREAIAGISVSGPTSRISVESIAELSRPVIEAAQQLTVAIGGDPAAL |
| 68 | MQHDIRKTRGRPKAWDDKAVQNTVKSLDRALEVLIALGEMQGGTLSEIATNLHQSPATVYRVLTTFQGRGFVDFDRQAQVWSIGAAAFLTGSQFLRRTSLVERARPIMRDLMEATGETANLGIERDGNVLFLGQVETHATIRAFFPPGTVSAMHASGIGKALLAHMDDARQRRVLAAGKLEQFTPHTLTNPEAMIADLHAARARGYAFDGEERNLGMRCIAATVHDVSGDAVAGLSVSGPTSRITDDKIAPLAQAVTEAAARLTAAIGGAPR |
| 69 | MSVQIRKRGRPRGRAGGLGAEDSGGIRALDRALDILDLIAVSSGLTLTEIAQRLDMAPSTVHRVLVTLAARGVAESDSQTQAWHVGPTAFRHGSAFMRRSGLVERARPLLRRLMEVTGETANLGILNGDAVLFLSQAETHETIRAFFPPGTRSALHASGIGKALLAHARPLDLKRMLREMRLERFTDMTLTDPAALVEDLVQIRARGYALDNEERTPGMRCIAAPIFDLAGEAAAGISVSGPTLRMSDARLSAMSDAVIEAARELSFGMAPRKDAGERA |
| 70 | MNTQKRPRGRPKSQFKESTAGTMQSLDRALGVLVAVAKSEQATLTDLSLSLGVPTATTHRILTTLQKHRFVAFNEEHQSWSIGIEAYRTGASFMNRTSLTEVSRPIMRLLMEKTGETANLAIPDGAEVVFVEQIETLHPIRAFFARGARTSMHASGIGKAILSTMSEEHVRRLLISSGLQAFTDNTLTSPASLFADLTETRARGYSYDREERYLGMSCIGSAIFDERGEACGGVSISGPSTRFDSLRVPELGAIVAEAAGQISQLIGGRGREPASSLPASNTPTA |
| 71 | MKMDIEARKRGRPRLFEGRDEDKVVRALDKGLVVLRVISESDGLSLSEIAETSEVSAPTAYRSLITMQMHGLVAFDDHTQLWRIDVEAFRVGSAFLSNSAVSEQARPVMQRLMESTGETSNLGILSDREVVFLSQAETHEPIRAFFRPGTRSPVHTSGIGKALLAFRPREEAQRLAEQLDMKPFTDNTICSADDLMKAVDEMVAQGFAVDDEERTLGMRCVAAPIFNSFGEAVAAISTSGPSVRVTKDRVLALGKQVRAAADEISRNIAGRIVDFS |
| 72 | MKDQTPSPRRSRGRPKNAFSDGQSSTIQALDRGLSVLSALARDGGGTLSDVSMRLGMPASTAHRVLATLEKHGYVDMDEASQTWRVGLEAFRVGTSFMQRTNLLEVGRASMRTLMEQTGETANLGILDNDHVVFIGQVETHNPIRAFHRPGSSGPMHASGIGKALLAAMPQGAVENLFRRTGLQQFSPKTLTDPEALLSDLRITRKRGWSFDNEERYEGMCCVAAVIYDSFREPIAGISVSGPSARFAPGALPALGAAVQTAARDVTAQIGGEMPQIAAE |
| 73 | MPDEPDSTVKHDHSRTQTRTQTRARGRPKAWRDKTEQNTIKSLDRALEVLSRLGDLEEATLSELANDLGQSPATIYRVLTTYRAHAFTDFDETRQVWSVGAGAFLTGAKFLRRTSMVERARPHLRRLMEATEETANLGVAKDADVLFLSQSETHHAIRAFFPPGTLSPMHASGIGKALLAQWPQKRVDAMLAARAPEQFTEYTLITRDALMDDLRETQLRGYSFDGEEKNIGMRCIAAPVFDVHGDAVAGLSISGPVARITDARIAPIGTLVRAGADALTRELGGVSPQPPG |
| 74 | MPQAPRRKGRPKNFDSASNPPTIQSLDRALDVLDALAGASGMTLTELSTALDQSAATMYRVLATLEARQIVEMEPQSQTWHIGAMAFRLGSAFLRRSSVIERARPVMRELMEATGETSNLGIERGGDVMFVSQVETYESIRAFFPPGTTSPMHASGIGKALLSCFGEDQLTRFLRGRTLTEFTEKTLTSAEALREDLAQIRRRGWSFDDEEKAPGMRCVAAPVFGMQGEVLAGISVSGPTSRMPDTRISEIGALVRGAAEKLSYGLGAPAADQAAPG |
| 75 | MSVQVRKRGRPRGRAGGFGAEDSGGIRALDRALDILDLIAASNGLTLTEIAQRLEMAPSTVHRVLVTLAARGVAESDSQTQAWHVGPTAFRHGSAFMRRSGLVERARPLLRRLMEVTGETANLGILNGDAVLFLSQAETHETIRAFFPPGTRSALHASGIGKALLAHASMMDLKRMLREMRLERFTGMTLTDPQALLEDLARIRARGYALDNEERTPGMRCIAAPIFDLAGEAAAGISVSGPTLRMSDERLAAMSEAVIAAARELSFGAPPAADGG |
| 76 | MIHGKENQPRKRGRPRGSGNSQAEDKGGVRALDRALDLMDILASEQGMTLSEIAQRMGLAPSTVHRVLTTLDARAVVESDPLTQAWHLGPTAFRYGSAFMRRSGLIERSRPVMRRLMELTGETANLGIRNGNAVLFIGQVETHETIRAFFPPGTRSPLHSSGIGKALLAFVRPEVLRTFFHEAVLDRFTPTTLTERADLVADLTETRARGYSIDNEERSPGMRCIAAPIFDMFGEPVAGISVSGPSHRMTEARLSDIGSAVVEAARALSLSGPAEDNF |
| 77 | MPAEPRRRGRPKAFNGPQTQNTIQALDRALDVLDALATPEGKTLSELAGQLGQSAATMHRVLATLERREFVEISPDRQVWHIGPEAYRLGAAFLRRSNVVERSRPIMRELMLETGETSNLGIEKDGNVLFISQVETHESIRAFFPPGTLSPLHASGIGKALLSTYDDNRLSALFKKKEFERFTDNTVRSFDQLREELQKTRDRGYSFDDEERTKGMRCVAAPILNVHGEAVAGISVSGPIHRLPDADIHQIGERVKSAARMVSRRLGAP |
| 78 | MAETKPRGRPRAFHDKTEQNTVQSLDRALGILRVLSESSGLTLTELAQAAHQSPATVYRVLSTYQTHGMVELEAQGQRWHIGAGAFRIGSAFLRRTKLAERAREAMQTLMRESGETANLGVEEQDEVLFLTQVETHEAIRAFFPPGTRSPMHVSGIGKALLAYYPPARVARITALGLPGFTPASLTDAARLENDLTRTRARGYAIDNEERTEGMRCIAAPIFNAHAEPVAGLSISGPVFRLSLERAREMGELVRRAAAGVTEATGGRVPE |

FIG. 12BI

| | |
|---|---|
| 679 | MEFQDNAARGPRKARGRPRDWEDKTAQNTIKSLDRAMEVFEFLSERQGIALSAIADDMGQSPSTIYRVL VTLEGRGLVEFDAEEQLWHIGPRAFMIGSRFLRRTSLVDRARPVMRALMEATGETANLGVEKEGKVLFLS QVETHANIRAFFPPGTLSAMHASGIGKALLAQMDDARLARRLEGGLDAFTEKTVTDRDRLMADLRQIRAR GYSCDDEERNIGMRCIAAPVFDINGEAIAGLSVSGPTSRVTAEALHKLSRPVVEAARMLTEAIGGKVTPPR V |
| 680 | MNTPKRARGRPRSAFSESGGATLQSLDRALGLLATVARFGHATLTDLALAQGLPAATAHRILTTLQKHGF VDFDRHSQEWMIGIEAYRTGSAYLRRAGLTEIGQPILRALMEKTGETANLAVPDGTEVVFIAQVETAHPIR AFFPAGTRSPMHASGTGKAILAMMPPERARTLLQKAGLPVFTSKTLSTPNALFQDLDRTRTRGWSYEAD ERHDGMSCIGAAIFDENGLPCAGISISGPSGRFKPDSLDRLGQAVAEAGAEITRLTGGTAPDRSS |
| 681 | MKSKRGRPKAFHDTTEQNTIQSLDRALHVVNYVAQSPDRSLTEIATALEQSPATVYRVLVTLAGHQMVEM DPAEQTWHIGAGAFRLGSAFLRRSSLVERARPVMRHLMERTGETANIGIEKNGRVLFLGQVETHESIRAF FPPGTQAPMHTSGIGKAILSHFGPERVHKIFESEAETYFTAHSLGTLDALTDDLALTRTRGFAVDNEERTL GMRCIAAPIFNSEGEAIAGLSISGPVVRISQDRVPEISRAVTEAAHKLTEAIGGPAIPVES |
| 682 | MPPKLRQRGRPKAFHDQTEKTRIQSLDRALDVLEALAAQGGQTLTEIAEDLGQSPATIYRILTTLEVRGMA EADPGDQTWHVGPGAFRLGSAFLRRASVVERARPVMRSLMESTGETANLAIEKGGKILFLSQVETHETIR AFSPPGTQSPLHASGIGKALLAFADPARIDGFLRDTLEAFTPKTITDPAAMRADLDRIRVCGYSFDDEERT EGMRCIAAPILNFYGEAVAGISVSGPTHRMREDRIEHLGALISRAAADLSRALGAP |
| 683 | MAEPTRRRGRPRSTTETSGTIQALDRALDILDLLAAHPGLTLSEVAEKMGQSPSTVHRVLHTLAARGVAE SDTATQTWHIGPATFRLGSAFMRRSGIVERARPVLRTLMEHTGETANLGILNGDAVMFVSQAETHETIRA FFPPGTRSPLHASGIGKALLAFGRPETLQVLLQNGELQRFTDKTLTTREALTEDMARIRNRGFSFDDEERT RGMRCIAAPVFDLTGEAIAGVSVSGPTHRIGPEHVKTLGAVVAAAASELSAAMGADR |
| 684 | MWNESTQMEKTGTVQAVERALTLLELLAGFPQGARLTLLAKRAGLAPSTAHRLLTTLERRGFAQFDPAG SRWRVGRRAFTVGVAFTRWQSFITAATPFLRRLRDLSHETANLGVLEDGEVITVAQVESREIIRAIASPGG RAPVMNSGMGKAIVATWPDEAIEAFIHRHGLHPVTRHSLTTLTEVMAEIALIRRRGYAFDDEEFIYGMRCA AAAVWDHSGQPVGAISVSALASRLPVAGMAEMGKAVRGVAGELSLTMGGKPPPIPA |
| 685 | MADPTRRRGRPCNDGPDRPLTVQALDRALDMLDLLSLHPGLTLSEVAQRTGLPASATHRILQTLALRGM VERCDATQCWAVGPSSFRLGAAFLRRSGLIARARPILQALVARTGETANLGILSDDGVLFVAQVESDQPIR VAFPPGTRACLHASGIGRAMLAVNARTAPEGLCRDLARIRRRGFAFDDQGRMAGMRCVAAPIVDLSGRA VAGLSINAPAHRIGGRQVTAIGAAVAEAAARLTAVTGEQLHL |
| 686 | MQQPVRKRGRPRGGKADQPAASIQALDRGLDVLEALAAHEGITLTGLSTHLDQSPATMHRVLATLEHRR YVENNPDRQEWFIGPEAFRLGSAFLRRTNIAERSRAVMRDLMAQAGETANLGIERDGDVLFVSQVETHQ TIRAFFPPGTRSPLHASGIGKALLAAFDPTRLAVVMRVAPFTRFTDKTIADADALHAEIALIRRRGFAVDDE ERTLGMRCVAASIVNSYGEAVAGVSVSGPTNRMTDAAVDRIGGMVATAAAQISANLGSGQGGPGGRIPL TP |
| 687 | MADPTRKRGRPRKTLPDAPGTVQSLDRALDLLDLLAAQPGLTLSEVAERSAQPPSTVHRVLHTLAARGM AESDPATQAWNIGPQAFRLGSAFMRRSGLVERARPIMRALMEHTGETANLGILQGDSVLFLSQVETSETI RAFFPPGTRSPLHASGIGKALLAFRPDSVAALGPLARFTDTTLTDPEALEADLARIRHRGFSFDDEERSRG MRCIAAPVFDLSGEAIAGISVSGPTHRIGAEHVKTLGAVVAAAAASLSDALGGPTP |
| 688 | METEVKRGRGRPKAWDDKGAQNTIKSLDRALEVLVQLGEMQGSTLSEIAGALGQSPATVYRVLTTFQGR GFADFDPQSQVVWSIGPAAFLTGSMFLRRTSLVERARPIMRDLMEATGETANLGIERDGQVLFLGQVETH ATIRAFFPPGTASAMHSSGIGKALLSRMDDKRQRAVLAAGKLEQFTPHTLTDPEAMIADLHATKARGYAF DGEERNIGMRCIAAPVYNVFGEAVAGISVSGPTSRITDDRIVALAEDVMEAATRLTRAIGGNHRPAS |
| 689 | VSDNPISSATRARGRPKAWTDKTDQNTIKSLDRALQILSRLGDMEEATLSELSSALSQSPATVYRVLTTFQ AHDFTEFNPTRQVWSVGAGAFLTGAKFLRRSSMVERARPHLRRLMEATEETANLGIAKGANVLFLSQSE THHAIRAFFPPGTVSPMYASGIGKALLALWSEKRVNALLAAQKIEQFTEHTLTDAAALTADLAETRARGYS FDAEEKNIGMRCIAAPVFDIYGEAIGGLSISGPVARITDNRISDIGAIVRSEANALTRTLGGVPPTEV |
| 690 | MSQPPRRKGRPKSFDSASQPATIQSLDRALDVLDALAGASGMTLTELSSALDQSAATMYRVLATLEARRI VEMEPQSQTWHIGAMAFRLGSAFLRRSSVIERARPVMRELMEATGETSNLGIERGGDVMFVSQVETHES IRAFFPPGTTSPMHASGIGKALLSCFGEDQLARFLRGRTLERFTEKTLTSAETLRADLAQIRNRGWSFDDE EKAPGMRCVAAPVFGMQGEVLAGISISGPTARMPDGGIYGIGTLVKDAAQKLSQGMGAPAA |
| 691 | MQPAKRRRGRPKGFNAPESQTVIQSLDRALDVLEAVAWPEGLTLSELAAHLGQSAATMHRVLATLERRE FVEISPDRQVVWHIGPEAYRLGSAFLRRTNVVERSRAIMRELMLETGETSNLGIEKDGNVLFISQVETHESI RAFFPPGTLAPLHASGIGKALLSTYDDSRLASLFQKATLERFTENTVRSFAQLKEELRATRDRGYAFDDEE RTQGMRCVAAPILNVHGEAVAGISVSGPTHRMPDKRVQQIGERVRSAAKTVSRRLGAP |
| 692 | VTEYSAVAVVSEQTKGKRGRKAGANSTPSSVQVLDRSLALFSLVADRDGSTLTDLADETGLAPSTIHRLL TSLSSHGMVAHDPDTGEWTIGVRAFEIGNAFLRFRKLGTISRPFLKRLMEESGETANIGIEDDGDVVFISQ VESHAPMRAFFRPGRRGPSHASGIGKAILSTWSDTEIAKTLGGKTLTHFTDRTLKTLPALIRNIQEIRNRG WSIDDEEHTLGMRCIAAPLFNEYGEAIGGISISGPSVRIDDDRLETLGSLVRRTADELTRAIGGHRPGES |

FIG. 12BJ

| | |
|---|---|
| 693 | MKSQANASGGGRRARGRPRGWDDKTAQNTIKSLDRAMEVFEYLSEAQGKPLTMLADEMGQSPATVYRI LVTLEGHRLVEFDHEEQVWHIGTGAFVIGARYLRRTSLVDRARPIMRKLMEATGETANLGIEREAAVLFLS QVETHANIRAFFPPGTLSPMHASGIGKALLAHMDEDRLDRLLARTDLQAFTEHSITDRSALKEDLKTIRAR GFSVDNEEKNLGMRCIAAPVFDMNKEAVAGISVSGPTHRVDEAEIERLSSAVIGAAHQLTLAIGGGATEPR S |
| 694 | MEVFEFLSEAQGKTLSALAGDLEQSPATVYRILVTLEVRGLVEFDQADQVWHIGPRAFLIGARFLKRTSLV DRARPLLRQLMEATGETANLGIEQNGNVLFVSQVETNASIRAFFPPGTLSRLHASGIGKALLSQMDDHRIN RFLDRGPLEKFTEYTLTERSALIADLATTRARGYAIDGEERNLGMRCIAAPVFDIHDEAIAGISVSGPTTRVT PEEIERLSVAVLTASHKLTAAIGGATPDH |
| 695 | MPQEKRKRGRPKSFKDNPEQNTNQSVDRAFDILEILATTPGLSMTDIADRVRMSPATAYRILNTLQKRRLT DLDPENQTWHVGSELFRLGSAFLNRSSLVERARPVMRNLMEVTGETANIGIEREGEILFLSQVETHANIRA FFQPGARAPLHASGIGKALLSRFDRARVDKLIPQDRLEQFTMKTIFDKTRLFEELDHINRQGWALDDEERT QGMRCIASPVIDHLGEAIGGISVSGPSARMPDEKLVAMGNAVRKAASDLSNRLGAP |
| 696 | MANEHTRDAARPRGRPKAFNDATPQNTIKSLDRALHVLAELARMENATLTGLAQELSESPATVYRVLTTF QGHGIVDIDEAAQTWHVGPNAFLIGSGFLRRTSLIERSRPVLRKLMEATGETANLGIENDGEVLFVSQVET HASIRAFFPPGTKSPAHASGIGKALLAHFPKDRLDRVLSRELQGFTPHTLTRPEALLSDLEAIRARGYSVD NEERNEGMRCIAAPIRNTYGETIAGISVSGPTSRVGPDQVEALALSVREAAEEVSASLGAKASLPTAGKA G |
| 697 | MDTGNRRRGRPKGFGGAKPTATIQALDRALDVLDVLAGGDGLTLSELAGRLEQSVATMHRVLATLERRG LVEISADKQEWHVGAEAYRLGSAFLRRHNVVERSRSMMWTLMQETGETSNLGVEKDGNVLFVSQVETH ETIRAFFPPGSLSPLHASGIGKALLSTYAPARTERLFRGRTFARFTDKTIGSLDQLRDDVEATRRRGYAIDD EERSIGMRCVAAPILNVHGEAIAGISVSGPTHRLSDEKLRAIGERVRRGAAAVSRALGAPAATTEAPDEPD RD |
| 698 | MDSQDNAASPAKRARGRPRDWDDKTAQNTIKSLDRAMEVFEYLSEGRGKALTAISSEMGQSPATVYRIL VTLEGRGLVEFDRFEQVWNIGPRAFVIGARFLRRTSLVDRARPIMRKLMEATGETANLGIEKEGAVLFLSQ VETHASIRAFFPPGTLSPMHASGIGKALLAQMDEARLGRTLAGQTLDAFTPYTITDPAELRVGLEAVRAQG YALDGEEKTLGMRCIAAPVFDVNQEAVAGISVSGPISRVGPEDIDRLSAFVIKAARDLSSAIGGEMAQR |
| 699 | MSDEIRRKGRPKAFSADPKASTIQALDRAFDVLDVIAAHSGLTLSEIATALDQSPATMHRVLATLEARQVV ETDPVRQTWHIGAAAFRLGSAFLRRSSVVERARPVMRALMEETGETSNLGIERNSEVMFLSQVETHESIR AFFPPGTLSPMHASGIGKALLAAMPEDAVSKRLRHLTLERFTDKTILTTAELQADLVQIQRRGWAFDDEEK ALGMRCVAAPIRNLHGEPVAGLSISGPVQRLPLDRIEHIGARVRAAAQQLSQDLGAPDGPNGSPTG |
| 700 | MAERQTNGVQSVQRALALLERVAEAQCGARLTDLARDAGLAASTVHRLLTTLEQSGFVHADAASGRWH VGQRAFAVGAAYTKQRSFVAPALPFLKRLRDTTRETANLGVIEDGEVVTLSQVESREIMRAISPPGGRVP VMCSGMGKAILATWEDAAIDRAIERHGLRALTKRSLTSPKAVHAEIANIRQRGYALDDEEFVIGLRCVAAV VWGPAGEPACAISVSGLAARMTPEKVTQTGATVQRLAAELTEVLGGKPPESS |
| 701 | MSMASSSTPPASGPSRRARGRPRGWDDKTAQNTIKSLDRAMEVFEHLSATRGATLSVLAKDLDQSPAT VYRILVTLEGRGLVEFDPTAQHWHIGARAFVIGARYLRRTSLVDRARPVMRRLMEITGETANLGVARDTH VLFVSQVETHASIRAFFPPGTLSPMHASGIGKALLAQMSDDRLSRLIATAPLDQFTSRTLTEPATLRADLEA TRERGYSIDDEEKNEGMRCIAAPVLDFSGEAVAGISVSGPVSRISVAQTEEIAQAVMAAAAELSTAMGAE RPRS |
| 702 | MQLPVRRRGRPKSGRNEPPGSNIQALDRALDVVEALASHDGMTLTELSDHLRQSAATMYRVLSTLERRQ YVEINPERQEWFIGPEAFRLGSAFLRRTNIVESSRSIMRDLMARTGETSNLGIERDGDVLFVSQVETHETI RAFFPPGTRSPLHASGIGKALLSAFDDERLEAFINRARFIRFTDKTVANADQLREAVRQTRGQGYSLDDE ERTIGMRCVAAAIFNSYGEAVAGISVSGPTIRLPDSKVREIGQWVVEAANEISRRLGAR |
| 703 | MTQTKRARGRPKSQFADSSAGTMQALDRALSVLTAVARQEGVNLTDLSLSLGIPTATTHRILTTLQKRDF VRFDEERQDWTIGIEAYRTGVAYLKRTNLADAGRPVMRRLMEQTGETANLAVPDGAEVVFIGQVETQNPI RAFFPPGSRTPMHASGTGKAILAALPEDRLMALLKGAGLKGFTEETLITPRALFDDLAETRTRGWSFDRN ERYDGMSCIGAAIFNDRGEPCAGVSISGPSSRFRDAQISEFGAAVAQAAVQITHLIAGKGVLISETTGSR |
| 704 | MDTGNRRRGRPKGFGGAKPTATIQALDRALDVLDVLAGGDGLTLSELAGRLEQSVATMHRVLATLERRG LVEISADKQEWHVGAEAYRLGSAFLRRHNVVERSRSMMWTLMQETGETSNLGVEKDGNVLFVSQVETH ETIRAFFPPGSLSPLHASGIGKALLSTYAPARTERLFRGRTFARFTDKTIGSLDQLRDDVEATRRRGYAIDD EERSIGMRCVAAPILNVHGEAIAGISVSGPTHRLSDEKLRAIGERVRRGAAAVSRALGAPAATTEAPDEPG RD |
| 705 | MEIREGAIRRGTGQSRVSPLLASERVVTGYLAVAVVSEQTKGKRGRKAGANSTPSSVQVLDRSLALFSLV ADRDGSTLTDLADETGLAPSTIHRLLTSLSSHGMVAHDPDTGEWTIGVRAFEIGNAFLRFRKLGTISRPFL KRLMEESGETANIGIEDDGDVVFISQVESHAPMRAFFRPGRRGPSHASGIGKAILSTWSDTEIAKTLGGKT LMHFTGRTLDTVPALIRNIQEIRNRGWSIDDEEHTLGMRCIAAPLFNEYGEAIGGISISGPSVRIDDDRLETL GSLVRRTADELTRAIGGHRPGDG |
| 706 | MQVANRRRGRPKSFNGPQSQSVIQSLDRALDVLEALALPEGMTLSELAAHLGQSPATMHRVLSTLERRE LVEISPDRQVWHIGPEAYRLGSAFLRRTNIIERSRPIMRDLMLETGETSNLGIEKDGNVLFVSQVETHESIR |

FIG. 12BK

| | |
|---|---|
| | AFFPPGTLSPLHASGIGKALLSTYDDNRLVSLFKKTTLERFTENTVRSLAQLEDELRVTRDRGYALDDEER TKGMRCVAAPILNVHGEAVAGISVSGPTHRMPDRQVHQIGERVRDAAKMVSRRLGAP |
| 707 | MNVAFKKNERDFMDSPKDAETSPRRARGRPRGWEDNSAQNTIKSLDRAVEVLEYLSSRPGLTLSELAG DLDQSPATVYRILVTLEGRRLVEFDPTEQLWHIGPQAFVIGARFLRRTSLVERARPILRGLMEETGETANL GIVREASVLFVSQVETHESIRAFFPPGTLSPLHASGIGKALLAEMPGERLEKLRVRPMERFTPHTLASPEA LLNDLAAIRERGYSIDAEERNLGMRCIAAAVFDASGEAVAGISVSGPTIRMGEESTHEASRAVMRAARELT AAIGGVRPPVR |
| 708 | MPPSPRRKGRPKSFDSASQPPTIQSLDRALDVLDALAGASGMTLTELSTALDQSAATMYRVLATLEARQI VEMEPQSQTWHIGAMAFRLGSAFLRRSSVIERARPVMRELMEATGETSNLGIERGGDVMFVSQVETHES IRAFFPPGTTSPMHASGIGKALLSCFGEDQLTRFLRGRTLEQFTDKTLTSADTLREDLAQIRSRGWSFDDE EKAPGMRCVAAPVFGMQGEVLAGISVSGPAARMPDARINDIGALVRGAAEKLSYGLGAPPAEQSPPG |
| 709 | MQVVKRRRGRPKAFNAPESPSVIQSLDRALDVLEALASPEGLTLSELAAHLGQSAATMHRVLSTLERREF VEISPDRQVWHIGPEAYRLGSAFLRRTNVVERSRPIMRELMLETGETSNLGIEKDGHVLFISQVETHESIR AFFPPGTLSPLHASGIGKALLSTYDDSRRTSLFKKSTLERFTENTVRSIAQLEEELRVTDRGYAFDDEER TKGMRCVAAPILNVHGEAVAGISVSGPTHRMPDRQVQKIGERVRNAATKVSRRLGAP |
| 710 | MAVVSEQTKGKRGRKAGANSTPSSVQVLDRSLALFSLVADRDGSTLTDLADETGLAPSTIHRLLTSLSSH GMVAHDPDTGEWTIGVRAFEIGNAFLRFRKLGTISRPFLKRLMDETGETANIGIEDDGDVVFISQVESHAP MRAFFRPGRRGPSHASGIGKAILSTWSDTEIAKTLGGKTLTHFTDRTIDTLPGLIRNIQDIRNRGWSIDDEE HTLGMRCIAAPLFNEYGEAIGGISISGPSVRIDDNRLEALGSLVRRTADELTRAIGGHRPGES |
| 711 | MSVQIRKRGRPRGRAGGLGAEDSGGIRALDRALDILDLIAVSSGLTLTEIAQRLDMAPSTVHRVLVTLAAR GVAESDSQTQAWHVGPTAFRHGSAFMRRSGLVERARPLLRRLMEVTGETANLGILNGDAVLFLSQAETH ETIRAFFPPGTRSALHASGIGKALLAHARPADLKRMIREMRLERFTEMTLTDPQALLDDLACIRARGYALD NEERTPGMRCIAAPIFDLAGEAAAGISVSGPSLRMSDARLEAMSEAVIEAARELSLGMAPASRAGESG |
| 712 | MSVQIRKRGRPRGRAGGFGAEDSGGIRALDRALDILDLIAMSNGLTLTEIAQRLEMAPSTVHRVLVTLAAR GVAESDSQTQAWHVGPTAFRHGSAFMRRSGLVERARPLLRRLMEVTGETANLGILNGEAVLFLSQAETH ETIRAFFPPGTRSALHASGIGKALLAHARPADLKRMIREMALERFTPMTLSDPQALLDDLARIRARGYALD NEERTPGMRCIAAPIFDFAGEAAAGISVSGPTLRMSDARLEAMAEAVIAAARELSFGMAPPAAEG |
| 713 | MSAELRKRGRPRGRTAGAGAEDSGGIRALDRALDILDLIASSSGLTLSEIGQRLDMAPSTVHRVLVTLAAR GVAETDPATQAWHVGPTAFRHGSAFMRRSGLVERARPLLRRLMEQTGETANLGILNGDAVLFLSQAETH ETIRAFFPPGTRSALHASGIGKALLAHVRPAQLRLMLQGMALQRFTDKTLTEAQALEQDLARIRARGYSLD NEERTPGMRCIAAPIFDLSGEAAAGISVSGPTLRMSDARLEAMSEAVIAAARELSFGMTPARGTGGES |
| 714 | MTQTKRARGRPKSQFADSSAGTMQALDRALSVLTAVARQEGVNLTDLSLSLGIPTATTHRILTTLQKRDF VRFDEERQDWTIGIEAYRTGVAYLKRTNLADAGRPVMRRLMEQTGETANLAVPDGAEVVFIGQVETQNPI RAFFPPGSRTPMHASGTGKAILAALPEDRLMALLKGAGLKGFTEETLITPRALFDDLAETRARGWSFDRN ERYDGMSCIGAAIFNDRGEPCAGVSISGPSSRFHDAQISEFGAAVAQAAAQITHLIAGKVVAISETAGSR |
| 715 | MQVVKRRRGRPKAFNAPESPSVIQSLDRALDVLEALASPEGLTLSELAAHLGQSAATMHRVLSTLERREF VEISPDRQVWHIGPEAYRLGSAFLRRTNVVERSRPIMRELMLETGETSNLGIEKDGHVLFISQVETHESIR AFFPPGTLSPLHASGIGKALLSTYDDSRLTSLFKKSTLESFTENTVRSIAQLEEELRVTRDRGYAFDDEERT RGMRCVAAPILNVHGEAVAGISVSGPTHRMPDRQVQKLGERVRNAAMKVSRRLGAP |
| 716 | MEANGKGKRGRKAGENAAPASVQVLDRSLSLLAIIAEGDGSTLTALSERSGMAPSTVHRLLTSLAQHGM VANDAEAGTWTVGVKAFEIGNAFLRFRKLGTISRPFLKRLMDESGETANIGVEEDGDVVFISQVESHAPM RAFFRPGRRGPIHASGIGKAILSTWSDTEIAKTLSGRTLACFTGRTLATLPDLIRNVQEIRFRGWSVDDEEH TLGMRCIAAPLFNEYGEAIGGISISGPTVRIDNERLGVLGPAVRRTADELTRAIGGHRPEEG |
| 717 | MTVPVRRRGRPKGFNDPQTQNVVQSLDRALDVLEALASPEGMTLSELAKHLGQSAATMHRVLATLERR DYVEMSPDGQIFHIGPEAYRLGAAFLRRTNVIERSRPVMRELMLETGETSNLGIEKNGKVLFVSQVETHE SIRAFFPPGTLSPLHASGIGKALLSTYDEERFGALFKGTTLQRFTANTLRTVDQLREELEITRQRGYAFDDE EKAAGMRCVAAPVLNVHGEAVAGISVSGPAHRMPDRQVKRIGQRVIEAARLVSNRLGAS |
| 718 | MVSQDNPPSEPRRARGRPRDWSDKTAQNTIKSLDRAMEVFEFLSEHQGKALTTLASETDQSPATVYRIL VTLEGRGLVEFDAVEQLWHIGPRAFVIGARFLRRTSLVERARPVMRRLMEQTGETANLGIERGGQVLFVS QVETEATIRAFFPPGTLSPMHASGIGKALLAEMDDARLQRALAGKELTAFTPYSITHLDALRADLEQVRAR GYAVDAEERNIGMRCVAAPVFDIHQEAVAGISVSGPTSRVGLEDIERLSEAVRAAARDLTATLGG |
| 719 | MAGNDAVSGRRSRGRPRSWDDKSAQNVIKSLDRAMEVFAYLGQSGGVTLTELAHDLDQAPATIYRILVT LERHDLVEFDAQDQDWHIGSNAFLIGSRFLRRTSLVDRARPIMRTLMERTGETANLGVERAGQVLFVSQV ETHANIRAFFPPGTLSRFHASGIGKVLLAWMPEDRRRALIEGAPLERFTPHTIVRTDMLIRDLQAARERGY AIDAEERTLGMRCIAAPVFDVHGEVRAGLSVSGPTSRIDAAAIAGLGRAVTDAAAALTAALGGASIPPPP |
| 720 | MTQLSRRGRPRAFHDKTAQNTIQSLDRAMAILETLAQSEGMTLSTLASACGQSTATVYRVLITLQQREMV DLDPAGQVWHVGVGTFRAGTSFLRRTSLVERARAPMQALMRDSGETANLGVEQQDEVLFLTQVETHQA IRAFFPPGTIGPMHVSGIGKALLAWFDDARVAQVVARRGLQAFTPASLTSLDALQADCARTRARGFAFDD EERAPGMRCIAAPIFNPHGEPVAGVSVSGPAFRLEAGNLDRIGALVVETAARITAATGGVAPAAKAV |

FIG. 12BL

| | |
|---|---|
| 721 | MDSGNRRRGRPKGFGGAKPAATIQALDRALDVLDVLAGGDGLTLSELAGRLEQSVATMHRVLATLERRG LVEISADKQEWHVGAEAYRLGSAFLRRHNVVERSRSMMWTLMQETGETSNLGVEKDGNVLFVSQVETH ETIRAFFPPGSLSPLHASGIGKALLSTYAPARTERLFRGKTFARFTDKTIGSLDQLRDDVEATRRRGYAIDD EERSIGMRCVAAPILNVHGEAIAGISVSGPTHRLSDEKLRAIGERVRRGAAAVSRALGAPAATMTATPDAP GEPDQD |
| 722 | MADDRERRRKRGRPRSDRPQDATGTVQALDRGLRLLALLAEQDEMTLTEIGLDAGIAPTTAYRLLVTLQQ RDMVTFDEEAQTWSIGVETFRIGSAFLRRTNYLEAGRPVMRRLMEASGETSNMAIQDGSDVVFVSQIET HKPIRAFFRPGTRGHMHASGIGKALLAERSEQDVRAIITEKGLPAFTDTTLTTADALFADLARTRERGWAV DDEESTTGMRCLAAPVFNEYGEAIAGISISGLAVRLPDTVLDTLGPLVRDAADEVTDNIGGLLPARMATD |
| 723 | MTPPKRARGRPKSQFGESSAGTMQSLDRALSVLVAVAREDRATLTDLSLALGIPTATTHRILTTLQKRDFV RFDDERQDWSIGIEAYRTGVAFLKRTNLSDVGRPVMRRLMEQTGETANLAVRDGAEVVFIGQVETQNPI RAFFPPGSRTPMHASGTGKAIMAALPKDRLLSLLKGAGLKGFTEQTHVTPKALFDDLAKTRARGWSFDR NERYDGMSCIGSAIFNDRGEPCAGVSISGPSSRFSDAQIAEFGAAVAQAAAEITHLIAGQSVDTTG |
| 724 | MERYTEVTTPKTEGVQSVVRALRLLKLLSLNDEGLRVSDIARQAGLAVSTTHRLLTTLERQNFAQFEPDR ALWHVGREAFAVGAAFGRRHNFVAPALPYLRRLRDLTRETANLGILDQDELVTISQVESREIMRAISPPGG RVPTFCSGMGKAILATWEDADIAAFVARTGFHPMTKRSHRDMTTAMVDIKRIRSRGYALDDEEHVTGLRC LAAVVWSAQGEAVCAISVSGLAARLPDARLDAIGKQVAEAARELTQKLGGAPPG |
| 725 | MKTQDDKNQGPRKPRGRPRDWHDKTAQNTIKSLDRAMEVFEFLSDTQGKALTTLASDLNQSPSTVYRIL VTLEARGLVEFDQVDQVWHIGARAFVIGSRFLRRTSLVERARPHLRALMEKTGETANLGIRQHGRVLFVS QVETDATIRAFFPPGTLSRLHASGIGKALLAEMDPDRIEKLISDEPLERFTEFTLTDRDALKEDLRITRERGY SLDGEERNLGMRCIAAPVFDIHGEALAGISVSGPTSRVGVEQIPELSEAVLVAARDLSASIGGKS |
| 726 | MSQPPRRKGRPKSFDSASQPATIQSLDRALDVLDALAGASGMTLTELSSALDQSAATMYRVLATLEARRI VEMEPQSQTWHIGAMAFRLGSAFLRRSSVIERARPVMRELMEATGETSNLGIERGGDVMFVSQVETHES IRAFFPPGTTSPMHASGIGKALLSCFGEDQLARFLRGRTLERFTEKTLTSAETLRADLAQIRNRGWSFDDE EKAPGMRCVAAPVFGMQGEVLAGISISGPTARMPDGGIYGIGTLVKDAAQKLSQGMGAPAA |
| 727 | MAEPTRKRGRPRKDAPETSGTIQALDRALDMLDLLAAHPGLTLSEVAEQMKQSPSTVHRVLHTLAARGV AESDPATQTWHIGPATFRLGSAFMRRSGIVERARPILRTLMEHTGETANLGILNGDAVLFVSQAETHETIR AFFPPGTRSPLHASGIGKALLAFGRPEILRMLLDKAELPRFTDKTLTTAEALQEDTIRIRARGFSFDDEERT RGMRCIAAPVFDLTGEAVAGLSVSGPTHRIGHEHVKTLGAAVAASAQELTQALGG |
| 728 | MTQPRPRGRPRAFHDKTDQNTVRALDRAMGLLTALSETKGLTLSELAALSNQSPATVYRVLITLQGHDIV ELEEEAQRWHVGPGAFRIGSGFLRRTNVAERSRGAMQALMRATGETANLGVEDRDEVLFLTQVETHETI RAFFSPGTRGPMHCSGIGKALLAFLPAARVAAILKTQGLPGFTPRSITSETGLHADLDRTRARGYAIDDQE RAEGMRCIAAPIFNAHGEPIAGLSVSGPAFRIPLDAADGIGAEVRAAADRVTAATGGISPTEKSA |
| 729 | MDSKNNAGISHRKARGRPRDWDDKSAQNTIKSLDRAMEVFEFLSEAQGKTLTMLATDLSQSPATVYRILV TLEGRGLVEFDQDDQVWHIGPRAFVIGARFLRRTSLVERARPVLRSLMEDTGETANLGIEQNGHVLFVSQ VETTASIRAFFPPGTLSRMHASGIGKALLAEMEEQRIRKLLSKAPLEGFTEFTLTDHTALLEDLHLSKARGY AIDGEERNLGMRCIAAPVFDIHGEAIAGISVSGPTTRVGAEQVAALSEAVVAAASRLTVAIGGAPPPAQG |
| 730 | VTPPKRGRGRPKSQFSESSAGTMQSLDRALSVLVAVAREDRATLTDLSLALGIPTATTHRILTTLQKRDFV RFDDERQDWSIGIEAYRTGVAFLKRTNLSDVGRPVMRRLMEQTGETANLAVRDGAEVVFIGQVETQNPI RAFFPPGSRTPMHASGTGKAILAALPEDRLLTVLKGAGLKEFTEHTHVTPKALFADLEKTRARGWSFDRN ERYDGMSCIGSAIFNDRGEPCAGVSISGPSSRFSDAQIAEFGAAVAQAAAEITHLIAGQLVEVKA |
| 731 | MERYTEVINPKTEGVQSVARALRLLKILSQNDEGLRVSDIARQAGLAVSTTHRLLTTLELQNFSQFEPDRA LWHVGREAFAVGSAFGRRHNFVAPALPYLRRLRDLTRETANLGILDHDELVTISQVESREIMRAISPPGGR VPTFCSGMGKAILATWQDADIAAFVARTGFHPMTKRSHRNLTTAMVDIKRIRAQGYALDDEEHVTGLRCL AAVVWSAQGEAACAISVSGLAARLPESRLDAIGKQVADAARELTQKLGGTPPA |
| 732 | MTQARPRGRPRAFHDKTEQNTIQSLDRAMALLRALAKTNGLTLTELADRSGQSAATVYRVLVTLQGHEIV EFEEGAQRWHVGAGAFRIGSGFLRRANVAERSRGAMQALMRATGETANLGVENRDEVLFLTQVETHEA IRAFFPPGTRSPMHVSGIGKALLAYYPEARVAGIVAEKGLAGFTSLSITSEASLSRDLARTRERGFAIDDQE RAEGMRCVAAPIFNAHGEPVAGLSVSGPAFRMTLSEAARMGQEVRKAADSVTAAIGGTPHGA |
| 733 | MDSQENAPKATRRARGRPRDWHDKTAQNTIKSLDRAMEVFEFLSEAQGKPLTMIAEEMGQSPATVYRIL VTLEGRGLVEFDTEEQLWHIGARAFVIGARFLRRTSLVDRARPILRKLMEETGETANLGIEKEGHVLFLSQ VETHASIRAFFPPGTLSQMHASGIGKALLAQMESSRLDRLLATTRLEVFTDHTITDHEALKQDLTAIRAQGF AVDNEEKNAGMRCIAAPVFDMNREAIAGISVSGPTSRISAQEITQLSRPVIEAARALTLAIGGDVAS |
| 734 | MDFQNPVRRARGRPRAFDARTEQNTIKSLDRALMVLDELSHMESASLSELAQGLEESPATVYRILSTFA LHGVVEVDAAQQTWHIGADAFRIGSAFLRRTSLVERSRAVLRGLMKTTGETANLGVEKDGAVLFVSQVE THAPIRAFFPPGTLSPLHASGIGKVLLAHAPAGRLEQVAAKGLESFTPHTLADLGRLRADLDLIRARGHAV DDQERNLGMRCIAAPIRNVHGEVVAGISVSGPTSRVSPDHVPDLARAVIAAAAEVSAAIGAPGG |
| 735 | MNETKKPLRRGRPRLKANEEKAEVSLVVALDRGIQVLIFLADRRCATLAELAKVTAIPAATAHRLLTTLQQ RGMVVHDAEKGKWRIGPQSYRIGSTFEEGSNLLEVAPAEMRILSEETGETANLAIEEGGLLLFLVQVESE NPIRASFKNGTAAHFHTSGVGKAIMAFMDEAALESFLTPQILVQQTPNSITDVQELKAELCKSRERGWALD DEERFLGMRCAAPIFDSLGKVVAGVSVSGPITRFPDHKLEDLAKLVVKAATTISDKLTQSSAGS |

FIG. 12BM

| | |
|---|---|
| 736 | MDSQKRPRGRPKSLFKESSAGTMQSLDRALGVLTTVARLERAALSDLAREIDVPTATTHRILVTLQKHGF VAFDDERQEWMIGIEAYRTGASFLRRNSVLEIGRPILRRLMQDSGETANLAVPDGSEVVFVGQVETPNPI RAFFPPGARTPMYASGIGKAILAAMSEPGLAKTLGAIAPVEFTANTQIPGDGLQQDLAKTRARGWSHDRE ERYQGMSCIGSAIFNDRGEPCAGISVSGPTARFGADRAHALGELVLAAAREITHLSGGQTPKT |
| 737 | MQNLNRRRGRPKSFNEPQSSSVIQSLDRALDVLEALASPEGMTLSELSAHLDQSPATMHRVLATLERRE FVEISPDRQVWFIGPEAYRTGAAFLRRSNVVERSRPIMRELMLETGETSNLGIEKDGNILFISQVETHESIR AFFPPGTLSPLHASGIGKALLSTYDDGRLSALFKTSTLKRFTENTARSVAQLKEELIVSRERGYAIDDEERT KGMRCVAAPILNVHGEAVAGISVSGPTHRMPDRLIRQIGERVAGAAKTVSRRLGGG |
| 738 | MQNLNRRRGRPKSFNEPQSSSVIQSLDRALDVLEALASPEGMTLSELSAHLDQSPATMHRVLATLERRE FVEISPDRQVWFIGPEAYRTGAAFLRRSNVVERSRPIMRELMLETGETSNLGIEKDGNILFISQVETHESIR AFFPPGTLSPLHASGIGKALLSTYDDGRLSALFKTSTLKRFTENTARSVAQLKEELIVSRERGYAIDDEERT KGMRCVAAPILNVHGEAVAGISVSGPTHRMPDRLIRQIGERVAGAAKTVSRRLGGG |
| 739 | MQVVKRRRGRPKAFNAPESPNIIQSLDRALDVLEALASPEGLTLSELAAHLGQSAATMHRVLSTLERREF VEISPDRQVWHIGPEAYRLGSAFLRRTNVVERSRPIMRELMLETGETSNLGVEKDGNVLFISQVETHESIR AFFPPGTLSPLHASGIGKALLSTYDDSRLASLFKKTTLERFTANTVRSVAQLEEELRVTRDRGYALDDEER TKGMRCVAAPILNVHGEAVAGISVSGPTHRMPDRQVQQIGERVRNAAKMVSRRLGAP |
| 740 | VAVVSEQAKGKRGRKAGANSTPSSVQVLDRSLALFSLVADRDGSTLTDLADETGLAPSTIHRLLTSLSSH GMVAHDPDTGEWTIGVRAFEIGNAFLRFRKLGTISRPYLKRLMDESGETANIGIEDDGDVVFISQVESHAP MRAFFRPGRRGPSHASGIGKAILSTWSDTEIAKTLGGRTLTHFTDRTLDTLPALIRNIQEIRNRGWSIDDEE HTLGMRCIAAPLFNEYGEAIGGISISGPSVRIDDNRLEPLGSLVRRTADELTRAIGGHRPGEG |
| 741 | VTGDSEEDFTARGRGRPRSWHDKSEQNTIKSLDRAMEVLERLSEMKGATLSQISGDLGQSPASVYRVLF TLEARGIVDFDSGPQTWHIGAGAFLIGSRFLRRTSLLERALPVLRSLMDATGETANLGIEQSGQVLFLSQV ETMATIRAFFPPGTMSPMHASGIGKALLAQRGAGQVARILDAHGLERFTEFTHVTRDALLADLAETRARG YSIDGEEKNIGMRCVAAPIFDVHGVAVAGISVSGPSSRVVPDAIPGLGAQVIAAAAEITHGIGGRVSG |
| 742 | MLHHGRRRGRPRATKADPAASNIKSLNRALDVLEALAAHEGVTLSGLSSHLHESTATMHRVLSTLERREY VECDPERQEWFIGPAAFKLGSAFLGRTNLVERSRLVMRDLVTISGETSNLGIHRDGQVLFVSQVETQETI RAFLPPGTSAPLHASGIGKALLSSFDDDRLEAFISTAKFTRFTDRTISSANQLRKAIKLTRQCGYALDDEER TIGMRCVAATILDVHGEAVAGISISGPTIRMPDKKVRQIGKWVMEAANEISRRVGAG |
| 743 | MNAETGPERRARGRPRAWGDTTEQNKIKSLDRALVILERLSEWGGATLTDLSEDLKQSPATVYRVLYTF EARGMVDFDPVAQTWHIGAGAFHIGSRFLRRTSLVERARPFLRELMRKTEETANLGISRDGMVLFLSQVE THHNIRAFFPPGTMSPMHSSGIGKALLAQMDDKEVAAIIRKHKLTAFTEHTLVTPEALMSDLEATRKRGYA FDAEEKNDGMRCIAAPVFDMHGEPIAGVSISGPSARIPDERIESLGADVRDTAAKLTAALGGPSD |
| 744 | MIDPKPDSSATRRARGRPRAWDDKTEQNTIKSLDRAMAVFEHLSTQSGVSLSALSDQLGESTATLYRILF TLETRGLVEFDQAQQLWHIGPGAFIIGARFLRRTSLVERARPILRSLMEQTGETANLGVAQADQVLFVSQV ETHESIRAFFPPGTLSPLHASGIGKALLAFMDEDQCKRILKQTDRERFTEHTLCDADLLAADLEAIRARGFS IDGEEKNLGMRCIAAPVFNHYGEAVAGLSVSGPTSRVSPDRIAPFADAVKTAAAALTAALGGENALPQTK TAE |
| 745 | MSPEKRPRGRPKSAFKESSAGGLQSLDRALMLLSAVARRQSATLSDLARETDIPTATTHRILSTLQAQRY VAFDEERQEWRVGIEAYRTGLSFLARTSVAEVGRPVMRRLMADTGETANLAVPDGAEVVFIGQVETPNPI RAFFPPGTRTSMHASGTGKAILAALRPDRLARVMGRIVFDAYTPGTLASEAALRADLSETARRGWSLDLE ERHPGMSCIGAAIRDEQGDPCAGISVSGPTARFSPDRVPGLGRAVREAAREITELSGGRWA |
| 746 | MQDDVKRGRGRPKSWDNKAAQNTIKSLDRALEVLVQLGEMQGSTLSEIAVALDQSPATVYRVLTTFQGR GFADFDEQAQTWSIGPAAFLTGSHFLRRTSLVERARPIMRDLMEATGETANLGIERDGKVLFLGQVETHA TIRAFFAPGTASSMHSSGIGKALLCRMDDKRQREVLAASQLEQYTPFTLTDPEAMIADLHATKARGYAIDG EERNIGMRCIAAPVYNVFGEAVAGISVSGPTSRITEDRIEELATPVMDAAARLTRAIGGNNRPAG |
| 747 | MDQTTRRRGRPKGFNSPTSKTTIQSLDRAFDVLDCLAARDGLTLTDIAETLEQSPATIHRVLATLEARGIV DSDTGTQTWFIGAMAYRIGSAFLRRSGVVERARASMRELMQSTGETANLGIEQAGQVMFISQVETPQTIR AFFPPGTVSPMHASGIGKALLAQYADDRMAAFLKAHALTRFTDRTITDPDALREDMALTRARGWAWDDE EKAAGMRCVAAPIFNIFAEPVAGISVSGPTHRMDLARIEEIGAMVREAAAAVSRALGAETNKPSQVADQA AS |
| 748 | MDAQKRPRGRPKSLFKESSAGTMQSLDRALGVLTAVARLERSALSDLAREVEVPTATTHRILVTLQKHGF VIFDEERQEWMIGIEAYRTGASFLHRNNVLEIGRPILRRLMQDSGETANLAVPDGAEVVFVGQVETQNPIR AFFPPGARTPMYASGTGKAILAAMSDESLGKALGATKLIPFTENTCLPGSGLQRDLAKTRARGWSHDHE ERYEGMSCIGAAIFNDRGEPCAGISVSGPTVRFCSTRAPELAELVLTAAREITHLSGGRAPELSARHPGNP |
| 749 | MDSQENAPKATRRARGRPRDWHDKTAQNTIKSLDRAMEVFEFLSEAQGKPLTMIAEEMGQSPATVYRIL VTLEGRGLVEFDTEEQLWHIGARAFVIGARFLRRTSLVDRARPILRKLMEETGETANLGIEKEGHVLFLSQ VETHASIRAFFPPGTLSQMHASGIGKALLAQMESSRLDRLLAATRLEVFTDHTITDHEALKQDLTAIRAQGF AVDNEEKNAGMRCIAAPVFDMNREAIAGISVSGPTSRISVQEITQLSRPVIEAAHALTLAIGGDVTP |

FIG. 12BN

| 750 | MDSQDNGSRSPRKARGRPRDWEDKTAQNTIKSLDRAMEVFEFLSERQGMALSTISDEMGQSPSTVYRV LVTLEGRGLVEFDAEEQLWHIGARAFTIGARFLRRTSLVDRARPVMRRLMEATGETANLGVEKEGQVLFL SQVETHANIRAFFPPGTLSAMHASGIGKALLAQMDEDRLSRRLEGGLQSFTPRTITDRIALQEDLARIRAR GYSVDDEERNLGMRCIAAPVFDAAGEALAGISVSGPTSRVTADALDRLSRPVIEAARTLTEAIGGQVTRQ P |
| 751 | MSVQIRKRGRPRGRAGGFGAEDSGGIRALDRALDILDLIAMSNGLTLTEIAQRLEMAPSTVHRVLVTLAAR GVAESDSQTQAWHVGPTAFRHGSAFMRRSGLVERARPLLRRLMEVTGETANLGILNGEAVLFLSQAETH ETIRAFFPPGTRSALHASGIGKALLAHARPADLKRMIREMALERFTPMTLSDPQALLDDLARIRARGYALD NEERTPGMRCIAAPIFDFAGEAAAGISVSGPTLRMSDARLEAMAEAVIAAARELSFGMAPPAAEG |
| 752 | MSVQIRKRGRPRGRAGGFGAEDSGGIRALDRALDILDLIAMSNGLTLTEIAQRLEMAPSTVHRVLVTLAAR GVAESDSQTQAWHVGPTAFRHGSAFMRRSGLVERARPLLRRLMEVTGETANLGILNGEAVLFLSQAETH ETIRAFFPPGTRSALHASGIGKALLAHARPADLKRMIREMALERFTPMTLSDPQALLDDLARIRARGYALD NEERTPGMRCIAAPIFDFAGEAAAGISVSGPTLRMSDARLEAMAEAVIAAARELSFGMAPPAAEG |
| 753 | MAQGGRRGRGRPRSASSDTAATTVQALDRGIQVLATLSQFGRATLTDLAVTAEMAPSTVHRLLETLRQH SIVEFDEVDQTWAVGVEAFRIGSTYLLRANYIDAGRQMMRRMVERTGETANLGVPDAGDVVFVSQVETQ QPIRAFFPPGTRGHMHASGIGKALLAEMSSERVAAITRQRGLPAFTDNTITTLDRLNEDLAATRTRGWAID DQERQLGMRCLAAPIFNEFREIVAGISISGPAVRLPDDKLAEFGPLVRESADEVTHRIGGARP |
| 754 | MVAAKDLTGNLKNGAERRPRGRPRAFDDKTDQNVIKSLDRSLEVLGELARLEATTLSELARALDEAPATV YRILVTMQAHRMVEFDEAQQVWHVGAGAFLIGSAFLRRTGLIERARPVLRSLMEATGETANLGVESDGA VLFVSQVETHAAIRAFFPPGTKSPLHASGIGKVLLAHAAPDQVRRLLARPLQGYTDRTLTDSGELSAALAE VRARGYAVDNEERTEGMRCVAAGIRNAYGETVAGLSVSGPVSRVRPDAIPALAARVVEAAEAVSLALGA RPVSPPAG |
| 755 | MSDASTTNAPRRARGRPRGWNDKTGQNTIKSLDRAMEVFDHLSTTPGQTLSELAADLRQSPATVYRILIT LERRRLVEFERAEQLWHIGPHAFVIGSRFLRRTSLVERARPILRRLMEDTGETANLGIVQGGSVLFVSQVE THANIRAFFPPGSLSPLHSSGIGKALLADMSEERLNRMISHGPLETFTPNTLATKSALVADLAMTRQRGYA IDNEEKNLGMRCIASSVFDMHEEAVAGISISGPSIRMEPDQIARLSRFVVDAAADLTAALGGTPRQEPPSA |
| 756 | MDTGNRRRGRPKGFGGAKPTATIQALDRALDVLDVLAGGDGLTLSELAGRLEQSVATMHRVLATLERRG LVEISADKQEWHVGAEAYRLGSAFLRRHNVVERSRSMMWTLMQETGETSNLGVEKDGNVLFVSQVETH ETIRAFFPPGSLSPLHASGIGKALLSTYAPARTERLFRGRTFARFTDKTIGSLDQLRDDVEATRRRGYAIDD EERSIGMRCVAAPILNVHGEAIAGISVSGPTHRLSDEKLRAIGERVRRGAAAVSRALGAPAATTEAPDEPD RD |
| 757 | MQPAKRRRGRPKGFNAPESQTVIQSLDRALDVLEAVAWPEGLTLSELAAHLGQSAATMHRVLATLERRE FVEISPDRQVWHIGPEAYRLGSAFLRRTNVVERSRPIMRELMLETGETSNLGIEKDGNVLFISQVETHESI RAFFPPGTLSPLHASGIGKALLSTYDDSRLASLFKKATLERFTENTVRSFAQLEEELRATRDRGYAFDDEE RTQGMRCVAAPILNVHGEAVAGISVSGPTHRMSDKRVQQIGERVRSAAKTVSRRLGAP |
| 758 | VTEYSAVTVVSEQTKGKRGRKAGANSTPSSVQVLDRSLALFSLVADRDGSTLTDLADETGLAPSTIHRLL TSLSSHGMVAHDPDTGEWTIGVRAFEIGNAFLRFRKLGTISRPFLKRLMEESGETANIGIEDDGDVVFISQ VESHAPMRAFFRPGRRGPSHASGIGKAILSTWSDTDVAKTLGSKTLTHFTDRTLDTLPALIRNIQEIRNRG WSIDDEEHTLGMRCIAAPLFNEYGEAIGGISISGPSVRIDDDRLETLGSLVRRTADELTRAIGGHRPGES |
| 759 | MDSQDNGPRGSRKARGRPRDWADKTAQNTIKSLDRAMEVFEFLSERQGMALSTISDEMDQSPSTVYRV LVTLEGRGLVEFDAEEQLWHIGARAFTIGARFLRRTSLVDRARPVMRRLMEATGETANLGVEKEGQVLFL SQVETHANIRAFFPPGTLSAMHASGIGKALLAQMDEGRLMRRLDGGLEAFTPHTVTDRAALLEDLARIRA RGYSIDDEERNLGMRCIAAPVFDAAGEALAGISVSGPTSRVTQDELNRLSRPVIEAARTLTEAIGGQVTPR P |
| 760 | MPQKPRRRGRPKAFNGPQTQNTIQALDRALDVLDALATPEGKTLSELAGQLGQSAATMHRVLATLERRE FVEISPDRQVWHIGPEAYRLGAAFLRRSNVVERSRPIMRELMLETGETSNLGIEKDGNVLFISQVETHESI RAFFPPGTLSPLHASGIGKALLSTYDEDRLSALFRKKEFERFTENTVRSFEQLREELQKTRERGYSFDDE ERTKGMRCVAAPILNVHGEAVAGISVSGPIHRLPDADIHQLGERVRSAARMVSRRLGAP |
| 761 | MPKSIDSKTPRHRGRPRAFNEKTEQNTIKSLDRALGVLSQLAQIESATLSELASALKESPATLYRVLTTFAL HGIVEMDEANQTWHIGPEAYQIGSTFLRRTSLIDVSRPVMRLLMEQTGETANLGIEKSGSVLFVSQVETNA PIRAFFAPGTLSAMHASGIGKALLAHMDEKRLKRFAALGLETFTPHTLSTPETLAADMILTRTRGYALDDQ EKNLGMRCIAAPIHNAHGEVVAGVSVSGPTTRVSTDQIETLAAFVMRAAQDISFALGSTR |
| 762 | MSVQIRKRGRPRGRAGGLGAEDSGGIRALDRALDILDLIAVSSGLTLTEIAQRLDMAPSTVHRVLVTLAAR GVAESDSQTQAWHVGPTAFRHGSAFMRRSGLVERARPLLRRLMEVTGETANLGILNGDAVLFLSQAETH ETIRAFFPPGTRSALHASGIGKALLAHARPLDLKRMLREMRLERFTDMTLTDPAALVEDLVQIRARGYALD NEERTPGMRCIAAPIFDLAGEAAAGISVSGPTLRMSDARLSAMSDAVIEAARELSFGMAPRKDAGERA |
| 763 | MSSEPRKRGRPRGRASGSGDSGGVRALDRALDVLDAIAGASGLTLTEIAQRLALAPSTVHRVLVTLEGR GVAEIDEVTQTWHVGPTAFRHGSAFMRRTGLVERARPVLRRLMEATGETANLGILNGEAVLFLSQAETH ETIRAFFPPGTRSPLHASGIGKALLAHKPRREVEMVLDEMVLERFTPMTLCDRQALLDDLGTIRLRGYSLD NEERTPGMRCIAAPIFDPVGEAAAGISVSGPVLRMTDARLPAISEAVLRAARELSFGTAAGGDHPVRESD HA |

FIG. 12BO

| | |
|---|---|
| 764 | MTQTKRPRGRPKSQFSESSAGTMQSLDRALGVLTTVARQEGVNLTDLSLSLGIPTATTHRILTTLQKREF VRFDEERQDWTIGIEAYRTGVAYLKRTNLSDAGRPVMRRLMEQTGETANLAVPDGAEVVFIGQVETGNPI RAFFPPGSRTPMHASGIGKALLAALSEERRLALLKGAGLQGFTANTHVTPRALFEDLEQTAARGWSFDR NERYDGMSCIGAAIFNDRGEPCAGVSISGPSSRFSDARLPEFGRAVAQAAAQITHLIAGHDAEGT |
| 765 | MNTPKPESARLRGRPKAFNDKTDQNTIKALDRAMHVLRSLSELENATLTTLAQTTGDPAASVYRILVTLQA HDIVELDTSDQTWHVGPGAFQIGSVFLRRTSLIERAREPMRDLMEATGETANLGIRSGGDVLFVSQIETHA PIRAFFPPGTRGDLHASGIGKVLLSAMEPERRAAILPSPLPRYTDATLSDPEALAADLTRIAARGYSVDDEE KNTGMRCIAAPVRNLHGEVVAGISVSGPTSRVAPDRVADFARQVIDAAETLSQRLGARPRAPRDD |
| 766 | VQNHKKPRGRPKSIFKESSAGTLQSLDRALETLTTVAALERCTLSDLSRETGVPTATTHRILTTLSNRGYV SFDEQRQEWMIGIEAYRTGTSYLKRNNVVEIGRPILRKLMRDSGETANMAMPDGKYVVFVNQIETSNPIR AFFPHGARAPMYASGTGKALLAEMTSNALDTFLSDITFEPYTDRTHRSETSLLEDVSLIRQRGWSFDDEE RYAGMSCTGAAILNQFGIPCAGVSVSGPTARINKSNAAYFGEMVLEAAREITTAIGGQAR |
| 767 | MEITEKRRRGRPRAFNAPAEPNAVQSLDRALRILAIVADGDGLSLSEVAERSELATSTAYRMLTTLQNRG MVEFAEQEQLWSIGVEAYRIGSAFLRSRRLVDRARSAMQVLMEKTGETANLGVAEDDCVVFVSQVETHQ AIRAFFRPGTRSPFHASGIGKAILAYLSPERVEAIVDKTGLEPFTERTLADRDGLHIDLGEIRKRGWSVDDE ERYPGMRCVAAPIFNEFGEPIGGVSISGPTVRVTPERLAAIGPEVREAARQITAMIGGEMPKNG |
| 768 | MDSPKSTESTPRRNRGRPRGWDDNSAQYTIKSLDRAMEVLEYLSRRSGLTLSDLAGDLQQSPATVYRIL VTLEGRRMVEFDPAEQLWHIGPQAFVIGARFLRRTSLVERARPILRRLMEETGETANLGIVREDAVLFVSQ VETHESIRAFFPPGTLSPLHASGIGKALLAEIPNERLEKLLSRRMERFTPHTLASPDALRSDLEVIRTRGYA VDAEEKNLGMRCIAAAVFDASGEAAAGVSVSGPLIRMSEESTDETSRAVMHAARELTAAIGGVIPPAR |
| 769 | MQPAKRRGRPKGFNAPESQTVIQSLDRALDVLEAVAWPEGLTLSELAAHLGQSAATMHRVLATLERRE FVEISPDRQVWHIGPEAYRLGSAFLRRTNVVERSRAIMRELMLETGETSNLGIEKDGNVLFISQVETHESI RAFFPPGTLAPLHASGIGKALLSTYDDSRLASLFQKATLERFTENTVRSFAQLKEELRATRDRGYAFDDEE RTQGMRCVAAPILNVHGEAVAGISVSGPTHRMPDKRVQQIGERVRSAAKTVSRRLGAP |
| 770 | VTEYSAVAVVSEQTKGKRGRKAGANSTPSSVQVLDRSLALFSLVADRDGSTLTDLADETGLAPSTIHRLL TSLSSHGMVAHDPDTGEWTIGVRAFEIGNAFLRFRKLGTISRPFLKRLMEESGETANIGIEDDGDVVFISQ VESHAPMRAFFRPGRRGPSHASGIGKAILSTWSDTEIAKTLGGKTLTHFTDRTLKTLPALIRNIQEIRNRG WSIDDEEHTLGMRCIAAPLFNEYGEAIGGISISGPSVRIDDDRLETLGSLVRRTADELTRAIGGHRPGES |
| 771 | MSQPPRRKGRPKSFDSASQPATIQSLDRALDVLDALAGASGMTLTELSSALDQSAATMYRVLATLEARRI VEMEPQSQTWHIGAMAFRLGSAFLRRSSVIERARPVMRELMEATGETSNLGIERGGDVMFVSQVETHES IRAFFPPGTTSPMHASGIGKALLSCFGEDQLARFLRGRTLERFTEKTLTSAETLRADLAQIRNRGWSFDDE EKAPGMRCVAAPVFGMQGEVLAGISISGPTARMPDGGIYGIGTLVKDAAQKLSQGMGAPAA |
| 772 | MSQPPRRKGRPKSFDSASQPTTIQSLDRALDVLDALAGASGMTLTELSSALDQSAATMYRVLSTLEARQI VEMEPQSQTWHIGAMAFRLGSAFLRRSSVIERARPVMRELMEATGETSNLGIERGGDVMFVSQVETHES IRAFFPPGTTSPMHASGIGKALLSCFGEDQLARFLRGRSLERFTEKTLTSADALREDLVQIRSRGWSFDD EEKAQGMRCVAAPVFGMQGEVLAGISISGPTARMPDGGIDGIGALVKDAAQKLSQGMGAPAV |
| 773 | MTEDVKRGRGRPKAWDNKGAQNTVKSLDRALEVLVQLGEMQGGTLSEIAGALDQSPATIYRVLTTFQGR GFVDFDAQNQTWNIGPAAFLTGSHFLRRTSLVERARPIMRKLMEATGETANLGIERDGKVLFLGQVETHA TIRAFFPPGTASSMHSSGIGKALLCRMDNKRQREILAASQLEQYTPFTLTDPDAMIADLHATKARGYAIDA EERNIGMRCIAAPVYNVFGEAVAGISVSGPTSRITEDRIAELATPVMEAAAQLTGAIGGNNRPAG |
| 774 | MEHQKEADSGLRRSRGRPRDWHDKTEQNTIKSLDRAMQVFEYLSQEQGKPLSLLAEETGQSPATLYRIL VTLEGRGLVEFDAENQIWHIGSQAFVIGARFLRRTSLVERARPILRRLMEATGETANLGVEKGGMVLFLS QVETHENIRAFFPPGTLSPMHSSGIGKALLSQMSDDRFGQWLKDQQLEKFTDRTLANADNLRKDLKGIR QSGYSFDNEEKNVGMQCIAAPVFDMNGEVVAGLSISGPTSRMAMREIDDLGQAVIRSANELSNAIGGQV R |
| 775 | MSGAQNTQENPRRARGRPRGWDDKTEQNTIKSLDRAMEIFEYLSADQGKTLSQLASELSQSPATVYRVL ITLEARGLVEFDPEEQRWYVGARAFVIGARFLRRTSLVDRARPILRALMERTGETANLGIEKGGMVLFLNQ VETHESIRAFFPPGTLSDMHASGIGKALLAFMDEDRFGQWLKGRSLETFTAHTLVAPDALVQELRRTRAR GYAIDAEEKNLGMRCIAAPVFDMYGEAVAGISVSGPATRMGWDVTERISRSVVDAARDLTRAVGGSNRH DAG |
| 776 | MPERENDLIAGRKARGRPRAWDDKSGQNTIKSLDRAMAVFEHLSTQSGVSLSALSDQTGESTATLYRILF TLETRGLVEFDQAQQLWHIGPAAFIVGARFLRRTSLVERARPILRELMEETGETANLGIQKGDQVLFVSQV ETHASIRAFFPPGSLSPLHASGIGKALLAFMPETQCEKILKSAKRERFTSYTLCDAGLLKADLAQAQTRGY SIDGEEKNLGMRCIAAPVFNHYGEIAAGLSISGPTSRLTEDKIQSLGSAVMNAAGTLTSALGGEPPIETSDQ |
| 777 | MDQTTRRRGRPKGFNSPTSKTTIQSLDRAFDVLDCLAARDGLTLTDIAETLEQSPATIHRVLATLEARGIV DSDTGTQTWFIGAMAYRIGSAFLRRAGVVERARASMRELMQSTGETANLGIEQAGQVMFISQVETPQTIR AFFPPGTVSPMHASGIGKALLAQYSDDRMAAFLKAHALTRFTDRTITDPDALRQDMDLTRARGWAFDDE EKAAGMRCVAAPIFNIFAEPVAGISVSGPTHRMDLARIEEIGTMVREAAAAVSRALGAETGKPSQAADQA AS |

FIG. 12BP

| | |
|---|---|
| 77 | MLYFSYGELIFQNQKNELMTDLKSDSSATRRARGRPRAWDDKTEQNTIKSLDRAMAVFEHLSTQSGVSLSALSDQLGESTATLYRILFTLETRGLVEFDQAQQLWHIGPGAFIIGARFLRRTSLVERARPVLRSLMEQTGETANLGVAQADQVLFVSQVETHESIRAFFPPGTLSPLHASGIGKALLAFMDEDQCKRILKQTDRERFTEHTLCDAGLLAADLEAIRARGFSIDGEEKNLGMRCIAAPVFNHYGEAVAGLSVSGPTSRVSPDRIAPFAEAVKAAAAALTAALGGEIAPPQTKTVE |
| 779 | MQNLNRRRGRPKSFNEPQSSSVIQSLDRALDVLEALASPEGMTLSELSAHLDQSPATMHRVLATLERREFVEISPDRQVWFIGPEAYRTGAAFLRRSNVVERSRPIMRELMLETGETSNLGIEKDGNILFISQVETHESIRAFFPPGTLSPLHASGIGKALLSTYDDGRLSALFKTSTLKRFTENTARSVAQLKEELIVSRERGYAIDDEERTKGMRCVAAPILNVHGEAVAGISVSGPTHRMPDRLIRQIGERVAGAAKTVSRRLGGG |
| 780 | MSVQIRKRGRPRGRAGGFGAEDSGGIRALDRALDILDLIAASSGLTLTEIAQRLEMAPSTVHRVLVTLAARGVAESDSQTQAWHVGPTAFRHGSAFMRRSGLVERARPLLRRLMEVTGETANLGILNGDAVLFLSQAETHETIRAFFPPGTRSALHASGIGKALLAHARPADLKRMIREMRLERFTEMTLTDPQALLEDLARIRVRGYALDNEERTPGMRCIAAPIFDLGGEAAAGISVSGPTLRMSDARLAAMSEAVIEAARELSFGMAPRPGEGESA |
| 781 | MESRENDQRPHRKARGRPRNWVDKTAQNTIKSLDRAMEVFEFLSEAQGMTLTAISDEMGQSPATVYRILVTLQGRGLVGFDAEEQLWHIGPQAFVIGARFLRRTSLVDRARPILRKLMEATGETANLGTEKEGAVLFLSQVETNASIRAFFPPGTLSPMHASGIGKALLAEMDSERLERTLGRAELTIFTDRTITERAALLEDLKQIRSRGFSIDDEEKNTGMRCIAAPVFDMNREAIAGISVSGPTSRVDGGQIERLSRPVMEAAQELTIAIGGPATRPPS |
| 782 | MESQKRPRGRPKSMFKESSAGTMQSLDRALGVLTTVAGLERVALSDLAREVDVPTATTHRILVTLQKHGFVSFDEERQEWMVGIEAYRTGASFLRRNNVLEIGRPILRRLMLDSGETANLAVPDGPEVVFVGQVETQNPIRAFFPPGARTPMYASGTGKAILAALSEESLNKVLARTDLIAFTENTNLPQAGLHDDLAETRRRGWSYDHEERYEGMSCIGAAIFNDRAEPCAGISVSGPTVRFSLDRAPELGMLVRNAAQEITHLSGGRSPSQ |
| 783 | MTDLKSDSSATRRARGRPRAWDDKTEQNTIKSLDRAMAVFEHLSTQSGVSLSALSDQLGESTATLYRILFTLETRGLVEFDQAQQLWHIGPGAFIIGARFLRRTSLVERARPVLRSLMEQTGETANLGVAQADQVLFVSQVETHESIRAFFPPGTLSPLHASGIGKALLAFMDEDQCKRILKQTDRERFTEHTLCDAGLLAADLEAIRARGFSIDGEEKNLGMRCIAAPVFNHHGEAVAGLSVSGPTSRVSPDRIAPFAEAVKAAAAALTAALGGEIAPPQTKTVG |
| 784 | MDTGNRRRGRPKGFGGAKPTATIQALDRALDVLDVLAGGDGLTLSELAGRLEQSVATMHRVLATLERRGLVEISADKQEWHVGAEAYRLGSAFLRRHNVVERSRSMMWTLMQETGETSNLGVEKDGNVLFVSQVETHETIRAFFPPGSLSPLHASGIGKALLSTYAPARTERLFRGRTFARFTDKTIGSLDQLRDDVEATRRRGYAIDDEERSIGMRCVAAPILNVHGEAIAGISVSGPTHRLSDEKLRAIGERVRRGAAAVSRALGAPAATTEAPDEPGRD |
| 785 | MTQTKRARGRPKSQFADSSAGTMQALDRALSVLTAVARQEGVNLTDLSLSLGIPTATTHRILTTLQKRDFVRFDEERQDWTIGIEAYRTGVAYLKRTNLADAGRPVMRRLMEQTGETANLAVPDGAEVVFIGQVETQNPIRAFFPPGSRTPMHASGTGKAILASLPEDRLMALLKGAGLKGFTEETLITPRALFDDLAETRRRGWSFDRNERYDGMSCIGAAIFNDRGEPCAGVSISGPSSRFGDAQIAEFGAAVAQAATQITHLIAGKGVVISETNGSR |
| 786 | MSDPQSQGVQSVARALRLLQLLSQQDEGARVSDLARLAGLAVSTTHRLLTTLELQHFAQFDSDRALWHVGRGAFSVGAAFSRRHNFVAPALPLLRRLRDATRETANLGILDQDELVTLSQVESREIMRAISPPGGRVPAFCSGMGKAILATWPNADIADFVARTGFHPMTKRSHRSLSTAMVDIKRIRAQGYALDDEEHVTGLRCLAAVVWSPQAEAVCAISVSGLAARLPDARLSAIGRQVAEAAADLTLKIGGQRPV |
| 787 | MTVPVRRRGRPKGFNDPQTQNVVQSLDRALDVLEALASPEGMTLSELAKHLAQSAATMHRVLATLERRDYVEMSPDGQIFHIGPEAYRLGAAFLRRTNVIERSRPVMRELMLETGETSNLGIEKNGKVLFVSQVETHESIRAFFPPGTLSPLHASGIGKALLSTYDEERLAALFKGATLQRFTANTLRTIEQLREELEITRQRGYAFDDEEKAAGMRCVAAPVLNVHGEAVAGISVSGPAHRMPDRQIKRIGQRVIEAARLVSNRLGAS |
| 788 | MPQPPRRKGRPKGFDSASQPTTIQALDRALDVLDALAGASGMTLTELSTGLGQSAATMYRVLATLEARQIVEIEPQSQTWHIGAMAFRLGSAFLRRSSVIERARPVMRELMEATGETSNLGIERNGDVMFVSQVETHESIRAFFPPGTISPMHASGIGKALLSCFGEDQLARFLRGRTLERFTAKTLISAKALRADLLQIRSRGWSFDDEEKAPGMRCVAAPVFGMQGEVLAGISISGPASRMPDAGINGIGALVKDAAEKLSYGLGAPAAVETQPG |
| 789 | MNTQKRQRGRPKSQFKESSAGTMQSLDRALGVLVAVAKSEQSTLTDLSLSLGVPTATTHRILTTLQKHRFVIFNEEHQSWSIGIEAYRTGASFMNRTSLTEVSRPIMRFLMEKTGETANLAIPDGAEVVFVEQIETPHPIRAFFARGARTSMHASGIGKAILSTMSEDHVRRLLMSSGLQAFTDNTLTSPATLFADLAETKTRGYSYDREERYLGMSCIGSAVFDERGEACGGVSISGPSTRFDSMRVPELGAIVAEAAGQISQLIGGRRREPHADDIAPNPTADPAG |
| 790 | MPDDPDTAPFHAQSRARGRPKAWVDKTEQNTIKSLDRALEVLSRLGDLEEATLSELASDLGQSPATIYRVLTTYRTHAFTDFDESRQVWSVGAGAFLTGAKFLRRTSMVERARPHLRRLMEATEETANLGVAKDADVLFLSQSETHHAIRAFFPPGTLSPMHASGIGKALLAQWPKRVDAMLAARTPEQFTAFTLVTRDALMGDLRETQRRGYSFDGEEKNIGMRCIAAPVFDVYGDAVAGLSISGPVARITDEKIAEIGALVRAGADALTRELGGVSPHHPTRFEA |
| 791 | MTRELERRRRGRPKGFHESSVGPIRSIERAFDVLEVLASSDGVTLSELSERLGQSVTTMHRVLSTLERRRYAEHVIDCQEWHVGSQAFRLGSSFLRRNDVVEQSRPDMRELMLATGETSNLGIERQGDVLFVSQIETHESIRAFFPPGTLSPLHASGIGKALLSAFDAQRLARFLHTTELTCFTETTITSRDKLVDEVRQIQGRGYALDNEERSLGMRCVAACVTDMYDEVVAGISVSGPVSRLPLAAIPEIGMLVKQAAQRISEKMGASQFDK |

FIG. 12BQ

| | |
|---|---|
| 792 | MFFSYDEFVFHMRWKMARDITKTRGRPKAWDDKTAQNTLKSLDRALEVLIALGEMEGGTLSELAKALNQ SPATVYRVLTTFRQRGFVDFDEQNQTWYIGPTAFLTGSRFLRRTSLVERARPVMRELMEATGETANLGIE RDGKVLFLGQVETHATIRAFFPPGTVSAMHASGIGKALLAWMDDARQRRVLAAGRLERFTPHTLTEPEP MIADLHASRARGYAIDGEERNLGMRCIAAPVFNLYGEAVAGISVSGPTARMSEDRVPELAASVMSAAGRL SAAIGGSGNSRALAP |
| 793 | MSQPPRRKGRPKSFDSASQPATIQSLDRALDVLDALAGASGMTLTELSSALDQSAATMYRVLATLEARRI VEMEPQSQTWHIGAMAFRLGSAFLRRSSVIERARPVMRELMEATGETSNLGIERGGDVMFVSQVETHES IRAFFPPGTTSPMHASGIGKALLSCFGEDQLARFLRGRTLERFTEKTLTSAETLRADLAQIRNRGWSFDDE EKAPGMRCVAAPVFGMQGEVLAGISISGPTARMPDGGIYGIGTLVKDAAQKLSQGMGAPAA |
| 794 | MAEPRTRGRPRAFHDKSEQNTVQSLDRALGILRVLSESSGLTLTELAQAADQSPATVYRVLSTFQAHGM VELEAEGQRWHVGAGAFRVGSAFLRRTKLAERARGAMQTLMRETGETANLGVEEKDEVLFLTQVETHE AIRAFFPPGTRSPMHVSGIGKALLAYYPITRVARIMAQGLPGFTAASLTDGIALENDLIDTRARGYAIDNEE RTEGMRCIAAPIFNAHGEPVAGLSISGPVFRLSLERAKDMGELVRTAAAGVTEATGGRVPQKGAAGSLAR PG |
| 795 | MNSPKRPRGRPKSAFKESSAGTLQALDRALGVLTALARDEGTTLSDLSREIDIPTATTHRILTTLENHRFVT FDEERQEWAVGIEAWRTGTAFLKRNSVVEVGRPVMRRLMKETGETANLAVPDGLEVVFVGQVETPNPIR AFFPPGTRTAMHASGIGKAILAAMRPQAQQRLIEDMDLTPFTASTHVTLSGLTADLHSIAARGWSHDREE RHAGMSCIGAAILNDQGEPCAGISVSGPTVRFSGEGIADLGRRVAEAAQEITDLSGGAMRDV |
| 796 | MSVQIRKRGRPRGRAGGLGAEDSGGIRALDRALDILDLIAVSSGLTLTEIAQRLDMAPSTVHRVLVTLAAR GVAESDSQTQAWHVGPTAFRHGSAFMRRSGLVERARPLLRRLMEVTGETANLGILNGDAVLFLSQAETH ETIRAFFPPGTRSALHASGIGKALLAHARPLDLKRMLREMRLERFTDMTLTDPAALVEDLVQIRARGYALD NEERTPGMRCIAAPIFDLAGEAAAGISVSGPTLRMSDARLSAMSDAVIEAARELSFGMAPREDAGERA |
| 797 | MENQKRPRGRPKSLFKESSAGTMQSLDRALGVLTTVARLERAALSDLAREVGVPTATTHRILVTLQKHGF VAFDEERQEWMTGIEAYRTGASFLRRNSVLEIGRPILRRLMQDSGETANLAVPDGAEVVFVGQVETLNPI RAFFPPGARTPMYASGTGKAILAAMSDDGLARTLAIANPVPFTGNTLVQEKTLRSDLSETRARGWSHDR EERYEGMSCIGAAIFNERAEPCAGISVSGPTVRFDAARAPELGARVVEAAQEITRLSGGRNPNVPGD |
| 798 | VATGDDTPESGRRARGRPRGWHDRTEQNTIKSLDRAMEVLDRLSELPGVSLSALAADLDQSPATVYRVL TTLEGRGLVEFDAEAQLWHVGAQAFVIGARFLRRTSLVERARPILRNLMEATGETANLGVARGPAVLFVS QVETDASIRAFFPPGTLSPMHASGIGKALLARMDERRLARLLSTPLERFTEHTFCDADALRTELAATRARG WALDGEEKTLGMRCIAAPVFDMSGEAVAGVSVSGPVSRVSDGSIDRVAQEVCAAAAALTAAVGGVWPA PAGAGGRG |
| 799 | MDSPKDAEISPRRARGRPRGWEDNSAQNTIKSLDRAMEVLEYLSSRPGLTLSELAGDLDQSPATVYRILV TLEGRRLVEFDPTEQLWHIGPQAFVIGARFLRRTSLVERARPILRGLMEETGETANLGIVREASVLFVSQV ETHESIRAFFPPGTLSPLHASGIGKALLAEMPGERLEKLRARPMERFTPHTLASPEALLNDLAAIRERGYSI DAEERNLGMRCIAAAVFDASGEAVAGISVSGPTIRMGEESTHEASRAVMRAARELTAAIGGVRPPVR |
| 800 | MDSQGNRDEPRRKARGRPRGWEDKTAQNTIKSLDRAMAVFEYLSEAQGKPLTLLADEMGQSPATVYRI LVTLEGRGLVEFDPEEQVWHIGPRTFVIGARFLRRTSLVDRARPIMRKLMEATGETANLGIEKEGAVLFLS QVETHANIRAFFPPGTLSAMHASGIGKALLAQMDDDRLDRHLATSELTAFTDCTLADPEALKADLRTIRAQ GYSVDNEEKNTGMRCIAAPVFDMNQEAVAGISVSGPTSRVSVAQIEQLSRPVMEAARDLTFAIGGAVAEP PT |
| 801 | MAPQVGRARGRPRSFHNTAQNSLIQSLDRAMDVLKVVAGGSGLSLTEIADRSGQSASTAYRILITLEKHR VVQFDEPAQLWHVGLEAFRIGSSFLGRTSIVEQSRPVMQRIMAETGETANLAIIDRGEVIFVSQVETHEPIR AFFRPGTRGPVHASGIGKALLAFLPEIQAQTILKQGAQDAYTDKTIVSGEALAAEMATIRTRGWAIDDEERT PGMRCIAAPIFNQFGEAVAGVSLSGPAFRITPKRDADYGVLVRKAADEITRAIGGMPPRG |
| 802 | MQNLNRRRGRPKSFNEPQSSSVIQSLDRALDVLEALASPEGMTLSELSAHLDQSPATMHRVLATLERRE FVEISPDRQVWFIGPEAYRTGAAFLRRSNVVERSRPIMRELMLETGETSNLGIEKDGNILFISQVETHESIR AFFPPGTLSPLHASGIGKALLSTYDDGRLSALFKTSTLKRFTENTARSVAQLKEELIVSRERGYAIDDEERT KGMRCVAAPILNVHGEAVAGISVSGPTHRMPDRLIKQIGERVAGAAKTVSRRLGGG |
| 803 | MADPTRKGRPRKTLPDAPGTVQSLDRALDLLDLLAAHPGLTLSEVADRSAQPPSTVHRVLHTLAARGM AESDPATQAWNIGPQAFRLGSAFMRRSGLVERARPIMRALMEHTGETANLGILQGDSVLFLSQVETSETI RAFFPPGTRSPLHASGIGKALLAFRPDSVAALGPLARFTDTTLTDPAALEADLARIRHRGFSFDDEERSRG MRCIAAPVFDLSGEAIAGISVSGPTHRIGAEHVKTLGAVVAAAAANLSDALGGPTR |
| 804 | MADPTRRRGRPCADGPDRPLTVQALDRALDMLDLLSLHPGLTLSEVAQRTGLPASATHRILQTLALRGM VERCAATQCWSVGPSSFRLGAAFLRRSGLIARARPILQDLVARTQETANLGILSDGGVLFVSQVESDQPI RVAFPPGTRASLTGSGIGRAMLAINAGPAPDTACPDLARIRRQGFAFDDQGRMAGMRCVAAPIVDMAGR AVAGLSINAPAHRIRTRQVGAIGAAVAEAAARLTAVTGEQLHL |
| 805 | MQQPVRKRGRPKGGKADQPAASIQALDRGLDVLEALAAHEGITLTGLSTHLDQSPATMHRVLATLEHRR YVENNPDRQEWFIGPEAFRLGSAFLRRTNIVERSRAVMRDLMALTGETANLGIERDGDVLFVSQVETHQT IRAFFPPGTRSPLHASGIGKALLAAFDQTRLAMFLRDATFTRFTDKTIADADALQADIALIRHRGFAFDDEE RTLGMRCVAASIVNSYGEAVAGVSVSGPTNRMTDAAVDRIGGMVATAAERISADLGSRGGR |

FIG. 12BR

| | |
|---|---|
| 80 6 | METQKRPRGRPKSLFKESSAGTMQSLDRALGVLTTVARSERSSLSDLAREVGVPTATTHRILVTLQKHGF VTFDEERQEWMVGIEAYRTGASFLRRNSVLEIGRPILRRLMQDSGETANLAVPDGAEVVFVGQVETQNPI RAFFPPGARTPMYASGTGKAILAALSEEGLKKVLGATDLTAFTENTYLPGPGLYEDLTETRARGWSFDRE ERYEGMSCIGAAIFNDRAEPCAGISVSGPTVRFSSEHAPELGELVLNAAQEITYLSGGRLPKG |
| 80 7 | MNSPKRPRGRPKSAFKESSAGTLQALDRALGVLTALARDEGTTLSDLSREIDIPTATTHRILTTLENHRFVT FDEERQEWAVGIEAWRTGTAFLKRNSVVEVGRPVMRRLMKETGETANLAVPDGLEVVFVGQVETPNPIR AFFPPGTRTAMHASGIGKAILAAMRPQAQQRLIEDMDLTPFTASTHVTLSGLTADLHSIAARGWSHDREE RHAGMSCIGAAILNDQGEPCAGISVSGPTVRFSGEGIADLGRRVAEAAQEITDLSGGAMRDV |
| 80 8 | MADEQRSRGRPKRFDGDESQNIIQSLDRAIDVLETLAQGGAMTLSQVASTMDQSPATIYRVLSTFRVRG MAEVNPASQEWSVGAEAFRIGSAFLRRSNVIARAMPIMQQLRDETGETSNLGIERDDNVVFIAQVETHESI RAFFPPGTQAPMHASGIGKALLAMFPEKHLARYLAQAHLPPFTANTICTPDGLRAHLVQIRTQGYSFDDE EKAIGMRCIAAPIVNFHGDAVAGVSISGPSHRLPCDGVARIGALVKAAGDKISASLGAL |
| 80 9 | MDSQDNLSSTGRRARGRPRDWDDKTSQNTIKSLDRAMEVFEFLSEAQGKALTTIATEMGQAPATVYRVL VTLEGRGLVEFDAVEQIWHIGPTAFVIGSRFLRRTSLVDRARPVLRKLMENTGETANLGAERDGSVLFLS QVETHSNIRAFFPPGSLSPMHASGIGKALLAEMDAGHLERTIDGAPLTAFTLHTITDKDALLADLETTRDRG YALDGEEKNLGMRCIAATVFDVNAEPVAGISVSGPTSRVGANDIPRLSLAVIDAARELTAAIGGIRPR |
| 81 0 | MSVQIRKRGRPRGRAGGPNAEDSGGIRALDRALDILDLIAVSSGLTLTEIAQRLGMAPSTVHRVLVTLAAR GVAESDSQTQAWHVGPTAFRHGSAFMRRSGLVERARPLLRRLMEQTGETANLGILNGDAVLFLSQAET HETIRAFFPPGTRSALHASGIGKALLAHAPPADLKRMIAGMALERFTPTTLTDPQALVQDLVRIRARGYAL DNEERTPGMRCIAAPIFDLGGEAAAGISVSGPSLRMSDARLASMSQAVIEAARALSFGMAPDPAPRDGT |
| 81 1 | MTQPRPRGRPRAFHDKTDQNTVRALDRAMGLLTALSETKGLTLSELAALSNQSPATVYRVLITLQGHDIV ELEEEAQRWHVGPGAFRIGSGFLRRTNVAERSRGAMQALMRATGETANLGVEDRDEVLFLTQVETHETI RAFFSPGTRGPMHCSGIGKALLAFLPAARVAAILKTQGLPGFTPRSITSETGLHADLDRTRARGYAIDDQE RAEGMRCIAAPIFNAHGEPIAGLSVSGPAFRIPLDAADGIGAEVRAAADRVTAATGGISPTEKSA |
| 81 2 | METPKRRMGRPKNFNSNEKQTTILALDRALDVVDALAHANGMTLSQLSAHLDQSPATMHRVLATLHARN FVEMDERAQTWHIGSAAFRMGSAFLRRSSIVERSRPIMRELMEATGETSNLGIERNGVVMFISQVETQES IRAFFPPGTLSPMHASGIGKALLSCYSETRTNQYLRMAELTRFTEKTIILPDMLKNELTVIREKGWAFDDEE KAEGMRCIAAPIRDIYGEAVAGVSISGPTHRIPKSEVERIGALVSDAAAQVSRGLGSS |
| 81 3 | MPQPPRRKGRPKSFDSASQPATIQSLDRALDVLDALAGANGMTLTELSASLDQSAATMYRVLSTLEARQI VEIEPQSQTWHIGAMAFRLGSAFLRRSSVIERARPVMRELMEATGETSNLGIERGGDVMFVSQVETHESI RAFFPPGTTSPMHASGIGKALLSCFEEDQLTRFLRGRTLEQFTAKTLTSPDALRADLAQIRSRGWSFDDE EKAPGMRCVAAPVFGMQGEVLAGISISGPTARMPDGGISGIGALVKDAAQKLSYGLGAPAADETPPG |
| 81 4 | MTQPKRPRGRPKSQFSESSAGTMQALDRALGVLTAVAREEGVNSDLSLSLGIPTATTHRILTTLQQRDF VRFDEERQDWTIGIEAYRTGVAYLKRTNLADAGRPVMRRLMEQTGETANLAVPDGAEVVFIGQVETQNPI RAFFPPGSRTPMHASGTGKAILAALPEERLLALLKGAGLKGFTDKTHVTPRALFDDLAQTRARGWSFDRN ERYDGMSCIGAAIFNDRGEPCAGVSISGPSSRFADMQIAEFGRAVAQAAAQITHLVAGRS |
| 81 5 | MVSQDNPPSEPRRARGRPRDWSDKTAQNTIKSLDRAMEVFEFLSEHQGKALTTLATETDQSPATVYRIL VTLEGRGLVEFDAVEQLWHIGPRAFVIGARFLRRTSLVERARPVMRRLMEQTGETANLGIERGGQVLFVS QVETEATIRAFFPPGTLSPMHASGIGKALLAEMDDARLQRALAGKTLTAFTPHSITDLNALRADLAQVRAR GYAVDAEERNIGMRCIAAPVFDIHQEAVAGISVSGPTSRVGLEDIERLSVAVRAAAADLSATLGG |
| 81 6 | METQKRPRGRPKSLFKESSAGTMQSLDRALVVLTAVARMERAALSDLAREVDVPTATTHRILATLQKHGF AAFDDERQEWMIGIEAYRTGASFLRRNSVIEIGRPILRRLMQDSGETANLAVPDGAEVVFVGQVEAQNPI RAFFPPGARTPMYASGTGKAILAAMSESAASKVLAAEAVRFTSHTLLPGEGLREDLANTRSRGWSHDHE ERYEGMSCIGAAIYNDRGEPCAGISVSGPSVRFIADRAMELGALVRDAAEEITQLSGGRLPKPSEE |
| 81 7 | MKSPNNGGRAIRKSRGRPRDFHDKTPQNTIKSLDRAMEVFEYLSTTQGRALSELAAEMDQAPATIYRILIT LEGRKLVEFDPTSQVWYIGPRAFVIGARFLRRTSLVDRARPVLRQLMEDTGETANLGIEQNGRVLFVSQV ETHASIRAFFPPGTLSRLHASGIGKALLAQMAPDRIERFLNAAPLERFTEFTLTGRDELLEDLEATRQRGFA LDGEERNLGMRCIAAPIFDVHNEAVAGISVSGPTSRVSPEQIPALSAAVLTAAKNLTDAIGGSAILPPA |
| 81 8 | MTESRRGRPKAFHDKTEQNTIRALDRAMALLQALAGSDGMTLTELAQAEGESPATTYRVLTTLAQRQMV ELDPRGQVWYVGAGTFRTGAAFLRRTNVVERARAPMQALMRATNETANLGIEQQGEVLFLTQVETHQAI RAFFSPGTRSALHASGIGKALMAWMPGLNPGPLTRFTEATITEPEALARNLALTRSRGWALDNQERTEG MRCVAAPIFNAHGEPVAGVSISGPVFRLPPDALPELGARVRAAAAEITRSIGGAVKS |
| 81 9 | MTQPRLRGRPRAFHDKTEQNTVRALDRAMGLLSALSETKGLTLSELATLTGQSPATVYRVLITLQGHDIV ELEDEAQRWHVGPGAFRIGSGFLRRTNVAERSRGAMQTLMRATGETANLGVEDRDEVLFLTQVETHEAI RAFFPPGTRGPMHTSGIGKALLAHLPPARVAAILKSKGLPGFTPLSITDEAALGEDLARTRARGYAIDDQE RAEGMRCIAAPIFNAHGEPVAGLSVSGPAFRIPLEAAARIGTEVRAAADRVTAAIGGTVGLAGAAEKSA |
| 82 0 | MTVPIRRRGRPKGFNDPQTQNVVQSLDRALDVLEALASPEGMTLSELAKHLDQSAATMHRVLATLERRD YVEMSPDGQIFHIGPEAYRLGAAFLRRTNVIERSRPVMRELMLETGETSNLGIEKNGKVLFVSQVETHESI RAFFPPGTLSPLHASGIGKALLSTYDEERLAFLFKGATLQRFTANTLRTIDQLKEELEITRQRGYAFDDEEK AAGMRCVAAPVLNIHGEAVAGISVSGPAHRISDRQVKRIGQRVIEAARLVSNRLGAS |

FIG. 12BS

| | |
|---|---|
| 821 | MTDLKSDSSATRRARGRPRAWDDKTEQNTIKSLDRAMAVFEHLSTQSGVSLSALSDQLGESTATLYRILF TLETRGLVEFDQAQQLWHIGPGAFIIGARFLRRTSLVERARPVLRSLMEQTGETANLGVAQADQVLFVSQ VETHESIRAFFPPGTLSPLHASGIGKALLAFMDEDQCKRILKQTDRERFTEHTLCDAGLLAADLEAIRARGF SIDGEEKNLGMRCIAAPVFNHHGEAVAGLSVSGPTSRVSPDRIAPFAEAVKAAAAALTAALGGEIAPPQTK TVG |
| 822 | MTQAVPIVRRRGRPSSTGGAEPGGEVQSLDRAIALLEVLARSDGLSLSELARSAELPTSTVHRLLTTLER RGLVGHDAATGSWMVGVGLFRVGSAYLRIRKLPEIARALLRELSHGVNETVNLSLIDGPHLICVAQVESH AAVRAFFRIGGDLPIHASGGGKAILATMNPEARRAWLGDDQLQRFTEHTHVSRRALQADLAEIAARGYSI DDEEHTPGMRCVAAAVLDEWREPVGAISISAPTVRMPPERIADLGAQVREAAARLTLRYSGR |
| 823 | MDSQENAPKATRRARGRPRDWHDKTAQNTIKSLDRAMEVFEFLSEAQGKPLTMIAEEMGQSPATVYRIL VTLEGRGLVEFDTEEQLWHIGARAFVIGARFLRRTSLVDRARPILRKLMEETGETANLGIEKEGHVLFLSQ VETHASIRAFFPPGTLSQMHASGIGKALLAQMDVGRLDRLLATTRLEVFTDHTITDHEALKQDLTAIRAQG FAVDNEEKNAGMRCIAAPVFDMNREAIAGISVSGPTSRISAQEITQLSRPVIEAARALTLAIGGDVAP |
| 824 | MDSPNNGAPEPTGRRPRGRPRAFDEKTEQNTIKALDRAMDILRALSRMDGATLTALAQETGDVPATVYR VLVTLQAHGIVEADEAAQTWHVGPGAFLIGSAFLRRTSLVERSRPALRRLMEQSGETANLGIASDDRVLF VSQVETHAPIRAFFPPGTRSAMHASGIGKVLMAAMDAPRLERIVAAGLTRYTPRTLTEPNALLADLEAIRK RGYAIDDEERNLGMRCIAAPIRNAHQEVIAGLSVSGPISRMTPDKTEALAVRVMTAAASVSAGMGARD |
| 825 | MQLRFSYGENIFQKVSHLQHEARKTRGRPKAWDDKAAQNTVKSLDRALEVLVALGEMQGGTLSEIASAL RQSPATVYRVLTTFQGRGFVDFDRQAQVWSIGAAAFLTGSQFLRRTSLVERARPIMRDLMEATGETANL GIERDGKVLFLGQVETHATIRAFFPPGTVSAMHASGIGKALLAHMDDARQRRVLAASKLEQFTPLTLTDPE AMIADLHATRMRGYAFDGEERNLGMRCIAVPIHDVSGEAVAGLSVSGPTTRIADDKIAELAQAVMAAAAR LTAAIGGTPR |
| 826 | MTVPVRRRGRPKGFNDPQTQNVVQSLDRALDVLEALASPEGMTLSELAKHLGQSAATMHRVLTTLERR DYVEMSPDGQIFHIGPEAYRLGAAFLRRTNVIERSRPVMRELMLETGETSNLGIEKNGKVLFVSQVETHE SIRAFFPPGTLSPLHASGIGKALLSTYDEERLGVLFKGATLQRFTANTLRTIDQLKEELEVTRQRGYAFDDE EKAAGMRCVAAPILNVHGEAVAGISVSGPAHRMPDRQIKRIGQRVIEAARLVSNRLGAS |
| 827 | MDSGNRRRGRPKGFGGAKPTETIQALDRALDVLDVLAESDGLTLSELAGKLGQSVATMHRVLATLERRA FVEISADKQEWHVGAEAYRLGSAFLRRHNVVERSRPMMWTLMQETGETSNLGVEKEGSVLFVSQVETH ETIRAFFPPGSLSPLHASGIGKALLATYEPDRTERLFRGKTFARFTDKTIGSLEQLREDIEATRHRGYAIDD EERTIGMRCVAAPILNFHGEAIAGISVSGPTHRLSDEKLKEIGERVRKGAATVSRLLGATTA |
| 828 | MPQEPRRRGRPKAFNGPQTQNTIQALDRALDVLDALATPEGKTLSELAGQLGQSAATMHRVLATLERRE FVEISPDRQVVWHIGPEAYRLGAAFLRRSNVVERSRPIMRELMLETGETSNLGIEKDGNVLFISQVETHESI RAFFPPGTLSPLHASGIGKALLSTYDEDRLSALFRKKEFERFTENTVRSFEQLREELQKTRERGYSFDDE ERTKGMRCVAAPILNVHGEAVAGISVSGPIHRLPDADIHQIGERVRSAARMVSRRLGAP |
| 829 | MAGEIRRRGRPKAFNEPEGEARVKAVDRALDVLDAIAASDGISLSRLADQLDESVATIHRVLGTLEHRDFV ECGADDQLWRVGSGAFRLGSSFLRRTNVVEQSRPALRQLMQLCGETANLGMEKEGFVLFLSQVETHEA IRAFFPPGTLSPLHASGIGKALLSTYDAPRFETFCATVPMVRFTDKTLTSAQDLARDIALARQRGFAVDDE EKSPGMRCVAAPIRNHHGEAVAGISVSGPTHRMGTERLDEIGAHVKAAATEVSRRLGAA |
| 830 | MVSQDNPPSEPRRARGRPRDWSDKTAQNTIKSLDRAMEVFEFLSEHQGKALTTLATETDQSPATVYRIL VTLEGRGLVEFDAVEQLWHIGPRAFVIGARFLRRTSLVERARPVMRRLMEQTGETANLGIERGGQVLFVS QVETEATIRAFFPPGTLSPMHASGIGKALLAEMDDARLQRALAGKTLTAFTPHSITDLNALRADLAQVRAR GYAVDAEERNIGMRCIAAPVFDIHQEAVAGISVSGPTSRVGLEDIERLSVAVRAAAADLSATLGG |
| 831 | MDSGNRRRGRPKGFGGAKPAATIQALDRALDVLDVLAGGDGLTLSELAGRLEQSVATMHRVLATLERRG LVEISADKQEWHVGAEAYRLGSAFLRRHNVVERSRSMMWTLMQETGETSNLGVEKDGNVLFVSQVETH ETIRAFFPPGSLSPLHASGIGKALLSTYAPARTERLFRGKTFARFTDKTIGSLDQLRDDVEATRRRGYAIDD EERSIGMRCVAAPILNVHGEAIAGISVSGPTHRLSDEKLRAIGERVRRGAAAVSRALGAPAATMTATPDAP GAPDRD |
| 832 | MDSGNRRRGRPKGFGGAKPAATIQALDRALDVLDVLAGGDGLTLSELAGRLEQSVATMHRVLATLERRG LVEISADKQEWHVGAEAYRLGSAFLRRHNVVERSRSMMWTLMQETGETSNLGVEKEGNVLFVSQVETH ETIRAFFPPGSLSPLHASGIGKALLSTYAPARTERLFRGKTFARFTDKTIGSLDQLRDDVEATRRRGYAIDD EERSIGMRCVAAPILNVHGEAIAGISVSGPTHRLSDEKLRAIGERVRRGAAAVSRALGAPAATMTATPDAP GEPDQD |
| 833 | MSVQIRKRGRPRGRAGGLGAEDSGGIRALDRALDILDLIAVSSGLTLTEIAQRLDMAPSTVHRVLVTLAAR GVAESDSQTQAWHVGPTAFRHGSAFMRRSGLVERARPLLRRLMEVTGETANLGILNGDAVLFLSQAETH ETIRAFFPPGTRSALHASGIGKALLAHARPADLKRMIREMRLERFTEMTLTDPQALLDDLACIRARGYALD NEERTPGMRCIAAPIFDLAGEAAAGISVSGPSLRMSDARLEAMSEAVIEAARELSLGMAPASRAGESG |
| 834 | MVLMDSQDNGGKRGPRRARGRPRGWEDKTAQNTIKSLDRAMEVFEYLSAAQGRSLTALASETRQAPAT VYRILVTLEGRGLVEFDAEDQTWHIGPRAYVIGARFLRRTSLVDRARPYLRRLMEDTGETANLGIEQEGA VLFLSQVETHASIRAFFPPGTLSPMHSSGIGKVLLAQMDDARLGRFLAATRLEVFTDHTITDREALRADLR KVRARGFSIDNEEKNAGMRCIAAPVFDLNGEAIAGISVSGPTSRVSMAEVDRLSRPVIAAARDLTHAIGGI MREV |

FIG. 12BT

| | |
|---|---|
| 83 5 | MSVQIRKRGRPRGRAGGLGAEDSGGIRALDRALDILDLIAVSSGLTLTEIAQRLEMAPSTVHRVLVTLAAR GVAESDSQTQAWHVGPTAFRHGSAFMRRSGLVERARPLLRRLMEVTGETANLGILNGDAVLFLSQAETH ETIRAFFPPGTRSALHASGIGKALLAHARPADLKRMIREMRLERFTEMTLTDPQALLDDLARIRARGYALD NEERTPGMRCIAAPIFDLAGEAAAGISVSGPSLRMSDARLEAMSEAVIEAARELSLGMAPHAGAGEER |
| 83 6 | MDSQENGPNEGRRARGRPRDWHDKTEQNTIKSLDRAMAVLEYLSRSKGLPLTRIAEDMGQSPATVYRV LVTLEGRGLVDFDADEQVWNIGPGAFVIGARFLRRTSLVDRARPIMRKLMEDTGETANLGIEKEGSVLFLS QVETHETIRAFFPPGTLSDMHSSGIGKALMAHMETDRLQRVLAKSSLQAFTEYTITDRDALMQDLAQIRAR GFSIDNEERTAGMRCIAAPVFDMNGEALAGISVSGPTSRVSPEEIARLGAPVTEAAKALTQAIGGVAPALT |
| 83 7 | MSDFFDEAQTHRNRGRPRAWDDKTSQNTIKSLDRAMGVLDYLSTLQGATLSELASDLGESAATVYRILVT LQSRELVEFDADGQLWHVGPRAFLIGTRYLRRTSLVDRARPILRRLMEITGETANLGIARNAHVLFVSQVE SHASIRAFFPPGTLSPMHASGIGKALLAEMPADRLSRVLAAAPLERFTDKTHTDAGALRADLTEIHARGYS VDDEEKNLGMRCIAAAVFDWHGEAVAGISVSGPLSRMSIEQTRELAKAVTTAAADLSAALGAETRVKPA |
| 83 8 | MADPTRRRGRPCADGPDRPLTVQALDRALDMLDLLSLHPGLTLSEVAQRTGLPASATHRILQTLALRGM VERCAATQCWSVGPSSFRLGAAFLRRSGLIARARPILQDLVARTQETANLGILSDGGVLFVSQVESDQPI RVAFPPGTRASLTGSGIGRAMLAINAGPAPDTACPDLARIRRQGFAFDDQGRMAGMRCVAAPIVDMAGR AVAGLSINAPAHRIGTRQVGAIGAAVAEAAARLTAVTGEQLHL |
| 83 9 | MQQPVRKRGRPRSGKADQPAASIQALDRGLDVLEALAAHEGITLTGLSTHLDQSPATMHRVLATLEHRR YVENNPDRQEWFIGPEAFRLGSVFLRRTNIVERSRAVMRDLMALTGETANLGIERDGDVLFVSQVETHQT IRAFFPPGTRSPLHASGIGKALLAAFDQTRLAVFLRDATFTRFTDKTIADADALQADIALIRHRGFAFDDEE RTLGMRCVAASIVNSYGEAVAGVSVSGPTNRMTDAAVDRIGGMVATAAERISADLGSGRGGR |
| 84 0 | MADPTRKRGRPRKTLPDAPGTVQSLDRALDLLDLLAAHPGLTLSEVADRSAQPPSTVHRVLHTLAARGM AESDPATQAWNIGPQAFRLGSAFMRRSGLVERARPIMRALMEHTGETANLGILQGDSVLFLSQVETSETI RAFFPPGTRSPLHASGIGKALLAFRPDSVAALGPLARFTDTTLTDPAALEADLARIRHRGFSFDDEERSRG MRCIAAPVFDLSGEAIAGISVSGPTHRIGAEHVKTLGAVVAAAAASLSDALGGPTR |
| 84 1 | METQENHPSRERRARGRPRGWDDKTAQNTIKSLDRAMQVFEYLSEDQGTTLTRLADGMGQSPATVYRI LVTLEGRGLVEFDPDEQVWHIGPRAFVIGARFLRRTSLVERARPIMRKLMEVTGETANLGVEKEGLVLFLS QVETHASIRAFFPPGTLSALHASGIGKALLAHMDRDRLDRLLSARDLQAFTHSTITRQDALRDSLSEIRALG YAVDHEERNEGMRCIAAPVFDINQEVVAGISVSGPTTRVNPAAVQRLSQPVIEAARDLTLAIGGRPLAVT |
| 84 2 | MPQPSRRRGRPRSGADSAGTIQSLERALDILDMLAGHSGLTLSEVADKMQQSPSTVHRVLHTLASRGVV ESDPATQSWQIGPAAFRLGSAFMRRSGIVERARPVLRALMEHSGETANLGILNGECVLFISQAETQETIRA FFPPGTRSPLHASGIGKALLAFGRPQTLDQTLAQAPLQRFTDKTLTQPQELRDDVARIRARGFAFDDEER TRGMRCIAAPVFDLTGEAVAGISVSGPTHRIGSEHVKTLGAVVAAAAADLTQKMGG |
| 84 3 | MNSPKRPRGRPKSAFKESSAGTLQALDRALGVLTALARDEGTTLSDLSREIDIPTATTHRILTTLENHRFVT FDEERQEWAVGIEAWRTGTAFLKRNSVVEVGRPVMRRLMKETGETANLAVPDGREVVFVGQVETPNPI RAFFPPGTRTAMHASGIGKAILAAMRPQAQQRLIEDMDLTPFTASTHVTLSGLTADLHSIAARGWSHDRE ERHAGMSCIGAAILNDQGEPCAGISVSGPTVRFSGEGIADLGRRVAEAAQEITDLSGGAMRDV |
| 84 4 | MDSGNRRRGRPKGFGGAKPAATIQALDRALDVLDVLAGGDGLTLSELAGRLEQSVATMHRVLATLERRG LVEISADKQEWHVGAEAYRLGSAFLRRHNVVERSRSMMWTLMQETGETSNLGVEKDGNVLFVSQVETH ETIRAFFPPGSLSPLHASGIGKALLSTYAPARTERLFRGKTFARFTDKTIGSLDQLRDDVEATRRRGYAIDD EERSIGMRCVAAPILNVHGEAIAGISVSGPTHRLSDEKLRAIGERVRRGAAAVSRALGAPAATMTATPDAP GEPDQD |
| 84 5 | MAEEPPQIAESRRARGRPRDWHDKTAQNTIKSLDRALEVLETLSDMGGATLSELAAEADQSPATVYRVLI TLEGRGMVEFNPTEQLWNIGARAFLIGSRFLRRTNLVERARPILRQLMEATGETANLGMERAGQVLFLSQ VETHASIRAFFPPGTLSPMHSSGIGKALMAQLSDARLDGIIAEHGLDQFTPHTLTDPDMLKADLAATRDRG YSIDAEERNEGMRCVAAPVFDAYGDVVAGISVSGPSSRIVDHMIAGFGEQVSQAAADLSRAIGADRP |
| 84 6 | MAIPDNPESGPRRTRGRPRGWDDKTAQNTIKSLDRAMAVFDHVSRGSGLALSTIAAETQESPATIYRILVT LAGRGLVEFDAEAQLWHIGPHAFTIGTRFLRRTSLVDRARPVLRRLMEATGETANLGVEREGAILFVSQV ETHASIRAFFPPGTLSPMHVSGIGKALLAAMPQDRLERLLAGQDFASFTEHTITDRDRLADELRRIRARGY AVDDEERNLGMRCIAAPVFDMNAEAVAGVSLSGPTSRVTPDAVVGLSGEVIAAAEALTRAIGGVARREV |
| 84 7 | MIEQAGKRRGRPKGSKSSSPATSIQALDRGIDVLEALAAHDGITLTELSAHLGQSSATMYRVLATLEQRRY VETSPERQEWFVGPEAFRLGSAFVRRTNIVERSRSIMRELMSKTGETSNLGIEREGHVLFVSQVESHETI RAYFPPGARSPLHASGIGKALLSAFDEERLEAFIKATNFTRFTDKTIATAGRLREEMHATRQRGYSFDDEE RTIGMRCVAACILNGYSEAVAGISISGPTPRMPDARIREMGLLVTEAAHEISRRLGAS |
| 84 8 | MATMEKRQRGRPRAFQPASDAGSVQSLDRALRILAIVAHGDGLSLSEISAASDLAAATAYRMLTTLQNHG MVEFDSDGQLWSIGVETYRMGAAFLRRRKLVDRARAVMQELMEKTGETANLGVAEDDCVVFVSQVETH QAIRAFFRPGTRSPFHASGIGKAVLAHLDRERVNAIVRKAGLDAYTERTLSEPALLARDLEKIRSRGWSVD DEERYPGMRCIAAAVFNEFGEPIGGVSVSGPTVRVTSERLGEIGPIVRDAAAELTRMIGGSPEGTVPGL |
| 84 9 | MDQDVKRGRGRPRAWDDKGDQNTIKSLDRALEVLVKLGELQGATLSELSALDQSPATVYRVLTTFQGR GFVDFDEIGQTWNIGPAAFMTGSHFLRRTSLVERARPIMRHLMEATGETANLGIERGGKVLFLGQVETHA TIRAFFPPGTEGAMHSSGIGKALLSRMDDARQRQVLAASKLEKFTPHTLTDPETMIADLRETRARGYAFD GEERNIGMRCIAAPVFNVYGEAVAGISVSGPTSRITDDRIQVLAEEVIDAAERLTRATGGNYRPAG |

FIG. 12BU

| | |
|---|---|
| 850 | MNMTVKRPRGRPRGADADRGGAVQSLERALGLLTALARQDSATLSDLALRTGTPPSTAHRLLTTMEASR YVAFDEATNLWTIGVEAFRTGSSFLRQTRVVDAARDVMRELVELTGETANVAVPDGGEVVFVSQVETSH PIRAFFGPGARAHMHASGIGKALLAAMGRAEVERRLQKVGLPEFTPNTLASPAALFADLERIRGRGWSLD DEERNLGMRCVAAAIRNAHGEAVAGVSISGPCVRLPHDRVAEVGPMVRRAAARITERIGGAQPDESAAA AS |
| 851 | MPKSIDSKTPRHRGRPRAFNEKTEQNTIKSLDRALGVLSQLAQIESATLSELASALKESPATLYRVLTTFAL HGIVEMDEANQTWHIGPEAYQIGSTFLRRTSLIDVSRPVMRLLMEQTGETANLGIEKSGSVLFVSQVETNA PIRAFFAPGTLSAMHASGIGKALLAHMDEKRLKRFAALGLETFTPHTLSTPETLAADMILTRTRGYALDDQ EKNLGMRCIAAPIHNAHGEVVAGVSVSGPTTRVSTDQIETLAAFVMRAAQDISFALGSTR |
| 852 | VGEIRRRGRPKAFNEPEGDARVKAVDRALDVLDAIAASDGISLSRLADALGESVATVHRVLGTLEHRDFV ECGTDDQLWRVGSGAFRLGSSFLRRTNVVEQSRPALHQLMQLCGETANLGMEKEGFVLFLSQVETHEA IRAFFPPGTLSPLHASGIGKALLSTYDAPRFRSFCEKAPMLGFTAQTLTSAEDLARDIALTRQRGFAVDDE EKSPGMRCVAAPIRNHHGEAVAGISVSGPTHRMGTERLEEIGAHVKNAATQVSRRLGAT |
| 853 | MENRKRPRGRPKSLFKESSAGTMQSLDRALNVLTTLARMERAVLSDLAREVDVPTATTHRILATLQKHSF AAFDDDRQEWMIGVEAYRSGASFLRRNSVIEVGRPILRRLMEESGETANLAVPDGAEVVFVGQVETPNPI RAFFPPGARTPMYASGTGKAILSAMSDTASSKVMSADAERFTSFTLLPGEGLRADLAETRARGWSHDHQ ERYEGMSCIGAAIFNDRGEPCAGVSVSGPSVRFSQDRAAGLGALVMRAAQEITELSGGRLPERSKR |
| 854 | MSEPTRRRGRPRSAKDQGGTVQVLDRALDMLDLLAAHPGLTLSEVADRMDQSPSTVHRLLHSLAARGM VESDPATQAWNIGPATFRLGSAFMRRSGIVERARPILRALMEHTGETANLGILNGDAVLFVSQAETHETIR AFFPPGTRSPLHASGIGKALLAFGRPEVLRGYLDGPGLKRFTDKTQVTVDALAQDMARIRARGFSFDDEE RTRGMRCIAAPVFDMSGEAIAGVSVSGPSHRIGHEHVKTLGAVVAAAAAELSAAMGG |
| 855 | MDSQETGPKTTRRARGRPRDWHDKTAQNTIKSLDRAMEVFEFLSEAQGKPLTSIAEDMGQSPATVYRIL VTLEGRGLVEFDTEEQLWHIGAQAFVIGARFLRRTSLVDRARPILRRLMEVTGETANLGIEKEGHVLFVSQ VETHASIRAFFPPGSLSQMHASGIGKALLAQMEASRLDRLLAATRLEVFTDHTITDGDALKQDLAAIRTQG FAVDNEEKNAGMRCIAAPVFDMNREAVAGISVSGPTSRISEQEIAELSRPVIEAAEQLTQAIGGVAPVAHK GGDP |
| 856 | MTVPVRRRGRPKGFNDPQTQNVVQSLDRALDVLEALASPEGMTLSELAKHLDQSAATMHRVLATLERR DYVEMSPDGQIFHIGPEAYRLGAAFLRRTNVIERSRPVMRELMLETGETSNLGIEQNGKVLFVSQVETHE SIRAFFPPGTLSPLHASGIGKALLSTYDEERLSVLFKGAALQRFTANTLRTINQLKDELEITRQRGYAFDDE EKAVGMRCVAAPVLNIHGEAVAGISVSGPAHRISDRQVKRIGQRVIEAARLVSNRLGAS |
| 857 | MESQDNGSGTGRKARGRPRGWTDKTAQNTIKSLDRAMEVFEYLSEAQGKPLSKLADEMRQSPATVYRI LVTLEGRGLVEFDHEEQVWYIGPRAFVIGARFLRRTSLVDRARPIMRKLMETTGETANIGVKEEAVLFLS QVETHANIRAFFPPGSLSPMHASGIGKALLAYMDPERLDKLLSKGQMTRFTAHTIIDPTALRQNLEAIRES GFSVDNEERNEGMRCIAAPVFDMNGEAVAGISISGPTSRVGASEVEELSRPVIKAAHQLSFAIGGSVTRP QP |
| 858 | MESQDNGSGTGRKARGRPRGWTDKTAQNTIKSLDRAMEVFEYLSEAQGKPLSKLADEMRQSPATVYRI LVTLEGRGLVEFDHEEQVWYIGPRAFVIGARFLRRTSLVDRARPIMRKLMETTGETANIGVKEEAVLFLS QVETHANIRAFFPPGSLSPMHASGIGKALLAYMDPERLDKLLSKGQMTRFTAHTIIDPTALRQNLEAIRES GFSVDNEERNEGMRCIAAPVFDMNGEAVAGISISGPTSRVGASEVEELSRPVIKAAHQLSFAIGGSVTRP QP |
| 859 | MAERQTNGVQSVQRALALLERVAEAQCGARLTDLARDAGLAASTVHRLLTTLEQSGFVHADAASGRWH VGQRAFAVGAAYTKQRSFVAPALPFLKRLRDTTRETANLGVIEDGEVVTLSQVESREIMRAISPPGGRVP VMCSGMGKAILATWEDAAIDRAIERHGLRALTKRSLTSPKAVHAEIANIRQRGYALDDEEFVIGLRCVAAV VWGPAGEPACAISVSGLAARMTPEKVTQTGATVQRLAAELTEVLGGKPPESS |
| 860 | MSDEIRRKGRPKAFSADPKASTIQALDRAFDVLDVIAAHSGLTLSEIATALDQSPATMHRVLATLEARQVV ETDPVRQTWHIGAAAFRLGSAFLRRSSVVERARPVMRALMEETGETSNLGIERNSEVMFLSQVETHESIR AFFPPGTLSPMHASGIGKALLAAMPEDAVSKRLRHLTLERFTDKTILTTAELQADLVQIQRRGWAFDDEEK ALGMRCVAAPIRNLHGEPVAGLSISGPVQRLPLDRIEHIGARVRAAAQQLSQDLGAPDGPNGSPTG |
| 861 | MVEIQRKPRGRPKSPFTDGSGGTIQALDRALAILSALAQQDHASLTDLSEDLAIPTATTHRILATLQQNGYA ELDESTQTWAVGVEAYRTGSAYLNRTNLADVSRPAMRALMQDTGETANLAVPDGAAVVFVGQIETQNPI RAFFAAGTRTPMHASGTGKAILAHLPATRQARLLSQIDLTVFTDQTLATLAELQADLASTQARGWSFDQE ERHLGMSCIGAPIYDARGEVVAGVSISGPSTRFSDRRVDAFGTRVAQAAAEITDGIGGRLPG |
| 862 | MQVVKRRRGRPKAFNAPESPSVIQSLDRALDVLEALASPEGLTLSELAAHLGQSVATMHRVLSTLERREF VEISPDRQVWHIGPEAYRLGSAFLRRTNVVERSRPIMRELMLETGETSNLGIEKDGHVLFISQVETHESIR AFFPPGTLSPLHASGIGKALLSTYDDSRLTSLFKKRTLERFTENTVRSIAQLEEELRVTRDRGYAFDDEER TKGMRCVAAPILNVHGEAVAGISVSGPTHRMPDRQVQKIGERVRNAATKVSRRLGAP |
| 863 | MEASGKGRRGRKAGENAAPSSVQVLDRSLTLFSLVADRDGSTLTDLADQTGLAPSTIHRLLTSLASHGM VAHDPDTGEWTIGVRAFEIGNAFLRFRKLGTISRPFLKRLMDESGETANIGIEDDGDVVFISQIESHAPMRA FFRPGRRGPIHASGIGKAILSTWSDTEIAKGLSGRTLTRFTRRTLDTLPALIKNVQEIRNRGWSVDDEEHTL GMRCIAAPLFNEYGEAIGGISISGPTVRIDDDKLEVLGPVVRLTADELTRAIGGHRPGEG |

FIG. 12BV

| | |
|---|---|
| 864 | MESQKRPRGRPKSMFKESSAGTMQSLDRALGVLTTVAGLERVALSDLAREVDVPTATTHRILVTLQKHG FVSFDEERQEWMVGIEAYRTGASFLRRNNVLEIGRPILRRLMLDSGETANLAVPDGPEVVFVGQVETQN PIRAFFPPGARTPMYASGTGKAILAALSEESLNKVLARTDLIAFTENTNLPQAGLHDDLAETRRRGWSYDH EERYEGMSCIGAAIFNDRAEPCAGISVSGPTVRFSLDRAPELGMLVRNAAQEITHLSGGRSPSQ |
| 865 | MAIVSEQTKGKRGRKAGANATPSSVQVLDRSLALFSLVADRDGSTLTDLADETGLAPSTIHRLLTSLSSH GMVAHDPDTGEWTIGVRAFEIGNAFLRFRKLGTISRPYLKRLMDESGETANIGIEDDGDVVFISQVESHAP MRAFFRPGRRGPSHASGIGKAILSTWSDTEIAKTLGGRTLTHFTDRTLDTLPALIRDIQEIRNRGWSIDDEE HTLGMRCIAAPLFNEYGEAIGGISISGPSVRIDDKKLDPLGSLVRRTADELTRAIGGHRPGEG |
| 866 | MQPAKRRRGRPKGFNAPESPSVIQSLDRALDVLEALASPEGLTLSELAAHLSQSAATMHRVLSTLERREF VEISPDRQVVWHIGPEAYRLGSAFLRRTNVVERSRPIMRELMLETGETSNLGIEKDGNVLFISQVETHESIR AFFPPGTLSPLHASGIGKALLSTYDDSRLASLFKKTTLERFTANTVRSIVQLEEELRVTKDRGYALDDEERT KGMRCVAAPILNVHGEAVAGISVSGPTHRMPDRQVQQIGERVRNAAKMVSRRLGAP |
| 867 | MSVQIRKRGRPRGRAGGLGAEDSGGIRALDRALDILDLIAVSSGLTLTEIAQRLDMAPSTVHRVLVTLAAR GVAESDSQTQAWHVGPTAFRHGSAFMRRSGLVERARPLLRRLMEVTGETANLGILNGDAVLFLSQAETH ETIRAFFPPGTRSALHASGIGKALLAHARPADLKRMIREMRLERFTEMTLTDPQALLDDLACIRARGYALD NEERTPGMRCIAAPIFDLAGEAAAGISVSGPSLRMSDARLEAMSEAVIEAARELSLGMAPASRAGESG |
| 868 | MVLMDSQDNGGKRGPRRARGRPRGWEDKTAQNTIKSLDRAMEVFEYLSAAQGRSLTALASETRQAPAT VYRILVTLEGRGLVEFDAEDQTWHIGPRAYVIGARFLRRTSLVDRARPYLRRLMEDTGETANLGIEQDGA VLFLSQVETHASIRAFFPPGTLSPMHSSGIGKALLAQMDDARLGRFLAATRLEVFTDHTITDREALRADLR EVRARGFSIDNEEKNAGMRCIAAPVFDLNGEAIAGISVSGPTSRVSMAEVDRLSRPVIAAARDLTHAIGGM MREV |
| 869 | MPERENDLIAGRKARGRPRAWDDKSGQNTIKSLDRAMAVFEHLSTQSGVSLSALSDQTGESTATLYRILF TLETRGLVEFDQAQQLWHIGPSAFIVGARFLRRTSLVERARPILRELMEKTGETANLGIQKGDQVLFVSQV ETHASIRAFFPPGSLSPLHASGIGKALLAFMPETLCEKILKSSKRERFTSYTLCDAGLLKADLAQAQTRGYS IDGEEKNLGMRCIAAPVFNHYGEIAAGLSISGPTSRVTENKIQSLGSAVMNAAGTLTSALGGEPPIETSDQ |
| 870 | MRDLMMATGETSNLGIERNGEVLFVSQVESHETIRAFFPPGASSPLHASGIGKALLSGFDEERFESFVRR THLTSFTDKTIVNADRLREAVRQIRRQGYSFDDEERTTGMRCVAAFISNGYGEAVAGISISGPTPRLPDDR IREIGARVVEAAREVSRRLGAE |
| 871 | MDSGNRRRGRPKGFGGAKPAATIQALDRALDVLDVLAGGDGLTLSELAGRLEQSVATMHRVLATLERRG LVEISADKQEWHVGAEAYRLGSAFLRRHNVVERSRSMMWTLMQETGETSNLGVEKDGNVLFVSQVETH ETIRAFFPPGSLSPLHASGIGKALLSTYAPARTERLFRGKTFARFTDKTIGSLDQLRDDVEATRRRGYAIDD EERSIGMRCVAAPILNVHGEAIAGISVSGPTHRLSDEKLRAIGERVRRGAAAVSRALGAPAATMTATPDAP GEPDQD |
| 872 | MDTGNRRRGRPKGFGGAKPTATIQALDRALDVLDVLAGGDGLTLSELAGRLEQSVATMHRVLATLERRG LVEISADKQEWHVGAEAYRLGSAFLRRHNVVERSRSMMWTLMQETGETSNLGVEKDGNVLFVSQVETH ETIRAFFPPGSLSPLHASGIGKALLSTYAPARTERLFRGRTFARFTDKTIGSLDQLRDDVEATRRRGYAIDD EERSIGMRCVAAPILNVHGEAIAGISVSGPTHRLSDEKLRAIGERVRRGAAAVSRALGAPAATTEAPDEPG RD |
| 873 | MTELRKKGRPRGRAGDSGDSGGIRALDRALDILDAIAAGNGLTLTEIGQRLQMAPSTVHRVLVTLAARGV AEQDASSQAWHVGPTAFRHGSAFMRRSGLVERARPVLRRLMETTGETANLGILNGDAVLFLSQAETHET IRAFFPPGTRSPLHASGIGKALLAHARPQELRAMIRGLRLERFTPHTLSEPEQLAEDLVRIRARGYSLDNE ERTLGMRCIAAPIFDLAGEAAAGISVSGPVHRMSDDRLAEITGAVVAAGRELSLGLGPGQGSGRGTEAKP |
| 874 | MKSQANASGGGRRARGRPRGWDDKTAQNTIKSLDRAMEVFEYLSEAQGKPLTMLADEMGQSPATVYRI LVTLEGHRLVEFDHEEQVWHIGTGAFVIGARYLRRTSLVDRARPIMRKLMEATGETANLGIEREAAVLFLS QVETHANIRAFFPPGTLSPMHASGIGKALLAHMDEDRLDRLLARTDLQAFTEHSITDRSALKEDLKTIRAR GFSVDNEEKNLGMRCIAAPVFDMNKEAVAGISVSGPTHRVDEAEIERLSSAVIGAAHQLTLAIGGGATEPR S |
| 875 | MQQPVRRRGRPKSAKADAQAPGIQSLDRALDVLEALAQHEGITLTELAVHLDQSPATMHRVLATLEQRK YVESNPDKQEWFIGSETFRLGSAFLRRTNIVERSRPVMRDLMARTGETSNLGIERDGDVLFVSQIETHETI RAFFPPGTRSPLHASGIGKALLSAFSDERLEIFLGSGKFTRFTDKTIANAKQLREAIEETRRRGYSFDDEER TIGMRCVAASIINGYGEAVAGISVSGPTIRMPDKRVREIGQLVSEAADEISRQLGSPAHAENPA |
| 876 | MPDDFPTESTGRAVRGRGRPKAWDDRSAQNTIKSLDRAMAVFEHLSTTTGATLSELAADTDQSPATTYR ILVTLEARGLVEFDAGPQLWHIGPRAFLIGARYLHRTSLVERARPVLRRLMERTGETANLGIARDGHVLFIS QVETHASIRAFFPPGTLSPMHASGIGKALLAQMTPEARARALAEAGLERFTARTLTDPAQIEADMVLTQAR GYAIDDEEKTEGMRCIAAPVTDLHGEVVAGISVSGPASRVSDAEIPRLAAAVTEAAATLSAALGAPAA |
| 877 | MREVRKRGRPKNVGTPDEAGGVKALERALDVLDLLAASNGLTLTEIAKALGTAPSTIHRVLTTLDARGVA ESDPITQAWHIGPSAFRHGTAFMRRSSIVERARPIMRRLMEATGETANLGILNGDAVLFLSQVETHETIRA FFPPGTRSPFHASGIGKALLAHAKPDVLRQILDDAVLSRFTDKTLTERDALLADLEVTRTRGYSFDDEERT LGMRCIAAPVYDLAGEAVAGISVSGPMHRMTEDRCGKIAEAVMVAAQDLSLGIPSRS |

FIG. 12BW

| | |
|---|---|
| 87 8 | MDSPKDAETSPRRARGRPRGWEDNSAQNTIKSLDRAMAVLDYLSAHPGLTLSELAGDLKQSPATVYRIL VTLEGRRLVEFDSAEQLWHIGPQAFVIGARFLRRTSLVERARPVLRGLMEETGETANLGIVREASVLFVS QVETHESIRAFFPPGTLSPLHASGIGKALLAEMAGERLEKLLARKMERFTAHTLAEPEALRADLSAIRARG YSIDAEEKTLGMRCIAAAVFDASGEAVAGISVSGPTIRMREDMTDTTSRAVMRAAQELTAAIGGVTPPVR |
| 87 9 | MDFPKNEPASPRKTRGRPRGWDDKTAQNTIKSLDRAMQVFEYLSEEQGKALSQLAEEMGQAPATVYRV LVTLEGRGLVEFDRYEQVWHIGPRAFVIGARFLRRTSLVDRARPIMRRLMEETGETANLGVEREGAVLFL SQVETHASIRAFFPPGTLSQMHASGIGKALLAHMDAGRLDRVFSSDVPKKFTEFTITDLSDLQTDLAGIRD RGYSVDNEEKNLGMRCIAAPVFDQNREAVAGISVSGPTSRVSPEEVERLSRPVVDAAHALTAAIGGEVVA |
| 88 0 | MSNARGRPRGWQEGERVKSLDRALGVLAALAGRPGLGLSELGRQLGQAPATLHRILGTLAAHGMAEMD ADQGWHVGPAAFRIGSAFLRRTSLVERAQPVLRALMRETGETANLGVVRDGHVLFLAQAETHAAIRAFF PPGTLSPLHASGIGKAVLAALPPERRLAALGDTLDGFTPHTLTAPDALGADLATAAARGWAIDAEERHEG MRCIACAVRDPSGAPVAGLSVSGPAARMLSAGEERIGRAVVARAQELSASLGTG |
| 88 1 | MDSPKSTESTPRRNRGRPRGWDDNSAQYTIKSLDRAMEVLEYLSRRSGLTLSDLAGDLQQSPATVYRIL VTLEGRRMVEFDPAEQLWHIGPQAFVIGARFLRRTSLVERARPILRRLMEETGETANLGIVREDAVLFVSQ VETHESIRAFFPPGTLSPLHASGIGKALLAEIPNERLEKLLSRRMERFTPHTLASPDALRSDLEVIRTRGYA VDAEEKNLGMRCIAAAVFDASGEAAAGVSVSGPLIRMSEESTDETSRAVMHAARELTAAIGGVIPPAR |
| 88 2 | MESQKRPRGRPKSLFKESSAGTMQALDRALGVLTTVAQLERVVLSDLAREVDIPTATTHRILVTLQKHGF VSFDEERQEWMVGIEAYRTGASFLRRNNILEIGRPILRRLMLDSGETANLAVPDGPEVVFVGQVETQNPI RAFFPPGARTPMYASGTGKAILAALSEDSLNKVLGQTDLIAFTENTNLPHAGLQEDLAETRARGWSYDHE ERYEGMSCIGAAIFNDRGEPCAGISVSGPTVRFDRERAPELGALVRNAAQEITHLSGGRSPGG |
| 88 3 | MATAEDGTGQRRARGRPRAWSDTTEQNRIKSLDRAIGVLERLSELGGATLSDLAEATDHAPASLYRILVT LESRGMVDFDPVPQTWHIGPSAFRIGSRFLRRTSLVERAPVLRTLMEATGETANLGIAREGHVLFVSQV ETHESIRAFFPPGTMSPMHASGIGKALLAQLPPERAAHIAAKHGLTRFTGRTLTAPEALAADLAQTRRRGY AIDDQEKTRGMRCIAAPIFDMHDEAVAGLSISGPADRLPDDAIPDIGAKVIEAAASVSRGLGAGRVASV |
| 88 4 | MDSQENAPKATRRARGRPRDWHDKTAQNTIKSLDRAMEVFEFLSEAQGKPLTMIAEEMGQSPATVYRIL VTLEGRGLVEFDTEEQLWHIGARAFVIGARFLRRTSLVDRARPILRKLMEETGETANLGIEKEGHVLFLSQ VETHASIRAFFPPGTLSQMHTSGIGKALLAQMESSRLDRLLATTRLEAFTDHTITDHEALKQDLATIRAQGF AVDNEEKNAGMRCIAAPVFDMNREAIAGISVSGPTSRISAQEISQLSRPVIEAARALTLAIGGDVTP |
| 88 5 | MPQAPRRKGRPKNFDSASNPPTIQSLDRALDVLDALAGASGMTLTELSTALDQSAATMYRVLATLEARQI VEMEPQSQTWHIGAMAFRLGSAFLRRSSVIERARPVMRELMEATGETSNLGIERGGDVMFVSQVETYES IRAFFPPGTTSPMHASGIGKALLSCFGEDQLARFLRGSALQDFTEKTLTSADALREDLAQIRRRGWSFDD EEKAPGMRCVAAPVFGMQGEVLAGISVSGPTSRMPDARISEIGALVRGAAEKLSYGLGAPAADQAAPG |
| 88 6 | MPQAPRRKGRPKNFDSASNPPTIQSLDRALDVLDALAGASGMTLTELSTALDQSAATMYRVLATLEARQI VEMEPQSQTWHIGAMAFRLGSAFLRRSSVIERARPVMRELMEATGETSNLGIERGGDVMFVSQVETYES IRAFFPPGTTSPMHASGIGKALLSCFGEDQLARFLRGSALQDFTEKTLTSADALREDLAQIRRRGWSFDD EEKAPGMRCVAAPVFGMQGEVLAGISVSGPTSRMPDARISEIGALVRGAAEKLSYGLGAPAADQAAPG |
| 88 7 | MSSEPRKRGRPRGRASGSGDSGGVRALDRALDVLDAIAGASGLTLTEIAQRLALAPSTVHRVLVTLEGR GVAEIDEVTQTWHVGPTAFRHGSAFMRRTGLVERARPVLRRLMEATGETANLGILNGEAVLFLSQAETH ETIRAFFPPGTRSPLHASGIGKALLAHKPRREVEMVLDEMVLERFTPMTLCDRQALLDDLGTIRLRGYSLD NEERTPGMRCIAAPIFDPVGEAAAGISVSGPVLRMTDARLPAISEAVLRAARELSFGTAAGGDHPVRESD HA |
| 88 8 | MEVFEHLSEAQGKTLSTISAETGQAPATVYRILVTLEGRGLVEFDHKEQIWHIGPQAFVIGSRFLRRTSLV DRARPILRKLMEVTGETANLGVEKEGAVLFLSQVETHASIRAFFPPGTLSPMHASGIGKALLAYMDTERLD RVLASAELQAFTERSITAPDALRADLARIRARGYSVDNEEKNAGMRCIAAPVFDATREAVAGISVSGPTSR VSESEIDRLSRPVIEAAQRLTQAIGGTFNDPRT |
| 88 9 | METQKRPRGRPKSLFKESSAGTMQSLDRALSVLTTVASLERAALSDLAREVDVPTATTHRILVTLQKHGF VAFDEERQEWMIGIETYRTGASFLRRNGVIEIGRPILRRLMQDSGETANLAVPDGAEVVFVGQVETANPIR AFFPPGARTPMYASGTGKAILAALNEAALIKALGTLDTKVFTPQTLVHGDGLQSDLNQTRARGWSHDREE RYEGMSCIGAAIFNDRGEPCAGISVSGPTARFSTERAPELGRLVQAAAQEVTLLSGGRLPARDAGDAGL |
| 89 0 | MVSQRNDKNDGPKARGRPRDWHDKTAQNTIKSLDRAMEVFEFLSEEQGKTLSQIADEMGQSPATVYRIL VTLETRGLVEFEGREQLWHIGPRAFIIGARFLRRTSLVDRARPVMRKLMELTGETANLGVEREGQVLFLS QVETHASIRAFFPPGTLSQMHASGIGKALLAHMEAGRRNRLLASEQLTEFTERTITDVDALLEDLLVIRER GYSVDDEERNMGMRCIAAPVFDFNGEAVAGISVSGPTSRVSPEETEKLARAVVSAAKELTLAIGGEIAAS |
| 89 1 | MESQDNSGTGRKARGRPRGWTDKTAQNTIKSLDRAMEVFEYLSEAQGKPLSKLADEMRQSPATVYRI LVTLEGRGLVEFDHEEQVWYIGPRAFVIGARFLRRTSLVDRARPIMRKLMETTGETANIGVGKEEAVLFLS QVETHANIRAFFPPGSLSPMHASGIGKALLAYMDPERLDKLLSKGQMTRFTAHTIIDPTALRQNLEAIRES GFSVDNEERNEGMRCIAAPVFDMNGEAVAGISISGPTSRVGASEVEELSRPVIKAAHQLSFAIGGSVTRP QP |
| 89 2 | MPQAPRRKGRPKNFDSASNPPTIQSLDRALDVLDALAGASGMTLTELSTALDQSAATMYRVLATLEARQI VEMEPQSQTWHIGAMAFRLGSAFLRRSSVIERARPVMRELMEATGETSNLGIERGGDVMFVSQVETYES |

FIG. 12BX

| | |
|---|---|
| | IRAFFPPGTTSPMHASGIGKALLSCFGEDQLTRFLRGRTLKEFTEKTLTSAEALREDLAQIRRRGWSFDDE EKAPGMRCVAAPVFGMQGEVLAGISVSGPTSRMPDTRISEIGALVRGAAEKLSYGLGAPAADQAAPG |
| 893 | MKPTARRKGRPKAFDSKPTQTTIQSLDRALEVLDTLALENGMTLTEVSDRLKQSPATMYRVLSTLQARGF VEIDAAAQTWHIGAMAFRLGSAFLRRSGVVDRSRPVMRDLMEATGETSNLGIERDGEVMFIGQVETTETI RAFFPPGTLSPMHASGIGKALLSQRDADSLGRFLRTYPLNRFTDKTIGTAPALQAELTAIRQQGYAFDDEE RTAGMRCVAAPILNLYGEAIAGISVSGPTHRMPADRIREIGRLVQQAANTVSRGLGAPEDT |
| 894 | MDSGSRRRGRPKGFGGAKPSATIQALDRALDVLDVLADGDGLTLSELAGTLGQSVATMHRVLATLERRG LVEISADKQEWHVGADAYRLGSAFLRRHNVVERSRSMMWTLMQETGETSNLGVEKDGNVLFVSQVETH ETIRAFFPPGSLSPLHASGIGKALLSTYAPARTERLFRGKTFARFTDKTIASLDQLRDDVEATRRRGYAIDD EERTIGMRCVAAPILNFHGEAIAGISVSGPTHRLSDAQLQAIGERVRKGAAAVSRALGAPAEAPDAGDRD |
| 895 | MDSGNRRRGRPKGFGGAKPAATIQALDRALDVLDVLAGGDGLTLSELAGRLEQSVATMHRVLATLERRG LVEISADKQEWHVGAEAYRLGSAFLRRHNVVERSRSMMWTLMQETGETSNLGVEKDGNVLFVSQVETH ETIRAFFPPGSLSPLHASGIGKALLSTYAPARTERLFRGKTFARFTDKTIGSLDQLRDDVEATRRRGYAIDD EERSIGMRCVAAPILNVHGEAIAGISVSGPTHRLSDEKLRAIASGCGEAPLRSRAPSARPPRR |
| 896 | MGEEATPRMRRTRGRPRGWRDNRGEYMIKSLDRAMEVLQYVSAHQGLTLSDLAAGLGQAPATVYRTLV TLEGRGLVEFDRDLQTWSMGAQAFVIGAQFLRRTSIVERAKPILRRLMEATGETANLGMVRERSVLFVSQ AETHAPIRAFFPPGTLSPLHASGIGKALLAHMPQERFDAFLSVPLPGFTASTLTTRAALLTDCDLTRERGY AVDEEEKTEGMFCVAAPVFDASGDAAAGISVSGPVARFGRDRIANIAVHVVGAAQSLSAAIGAPSSYRA |
| 897 | MPPPIRNKGRPKAFNTDTTANPIQSLDRALVVLETLAQSNGMTLSEIASHLDQSVATMYRVLSTLAARGFV ENDPQTQAWHIGPMSFRLGSAFLRRSSVVERARPVMRDLMQATGETANLGIEKDGHVMFLSQVETHESI RAFFPPGTLSPMHASGIGKALLSCYSDDALSWFLRTHARESFTEHTLCDPETLRAEMQNARHLGYAVDD EEKNLGMRCVAAPIFNFYGEAVAGISVSGPISRLTQERVAQVGADVKSAAESLSRGLGAEPDAPQS |
| 898 | MKSKRGRPKAFHDTTEQNTIQSLDRALHVVNYVAQSPDRSLTEIATALEQSPATVYRVLVTLAGHQMVEM DPAEQTWHIGAGAFRLGSAFLRRSSLVERARPVMRHLMERTGETANIGIEKNGRVLFLGQVETHESIRAF FPPGTQAPMHTSGIGKAILSHFGPDRVHKIFESEAETYFTAHSLGTLDALTDDLALTRTRGFAVDNEERTL GMRCIAAPIFNSEGEAIAGLSISGPVVRISQDRVPEISRAVTEAAHKLTEAIGGPAMPVES |
| 899 | MDSGNRRRGRPKGFGGAKPAATIQALDRALDVLDVLAGGDGLTLSELAGRLEQSVATMHRVLATLERRG LVEISADKQEWHVGAEAYRLGSAFLRRHNVVERSRSMMWTLMQETGETSNLGVEKDGNVLFVSQVETH ETIRAFFPPGSLSPLHASGIGKALLSTYAPARTERLFRGKTFARFTDKTIGSLDQLRDDVEATRRRGYAIDD EERSIGMRCVAAPILNVHGEAIAGISVSGPTHRLSDEKLRAIGERVRRGAAAVSRALGAPAATMTATPDAP GAPDRD |
| 900 | MSVQIRKRGRPRGRAGGLGAEDSGGIRALDRALDILDLIAVSSGLTLTEIAQRLEMAPSTVHRVLVTLAAR GVAESDSQTQAWHVGPTAFRHGSAFMRRSGLVERARPLLRRLMEVTGETANLGILNGDAVLFLSQAETH ETIRAFFPPGTRSALHASGIGKALLAHARPADLKRMIREMRLERFTEMTLTDPQALLDDLARIRARGYALD NEERTPGMRCIAAPIFDLAGEAAAGISVSGPSLRMSDARLEAMSEAVIEAARELSLGMAPHAGAGEGR |
| 901 | MPQKPRRRGRPKAFNGPQTQNTIQALDRALDVLDALATPEGKTLSELAGQLGQSAATMHRVLATLERRE FVEISPDRQVWHIGPEAYRLGAAFLRRSNVVERSRPIMRELMLETGETSNLGIEKDGNVLFISQVETHESI RAFFPPGTLSPLHASGIGKALLSTYDEDRLSALFRKKEFERFTENTVRSFEQLREELQKTRERGYSFDDE ERTKGMRCVAAPILNVHGEAVAGISVSGPIHRLPDADIHQLGERVRSAARMVSRRLGAP |
| 902 | MAENGVQSVARALSLMRLLAQEDGGSRLSDVARAAGLPVSTAHRLLTTLEQQGFAQFEPASSLWHVGR DAFTVGLAYGRRLSFVAPALPLLRRLRDATRETANLGILDDDHLVTVSQVESREIRRALSPPGRRVPVFSS AMGKAILATWRDQEVLALADRAGLPPLTTKSLRSREAALAEIARTRARGWALDDEEFNLGMRCLAAVVW SPQGEAACAISISGAAVRLTEDRLEPLGALVAQAAEELTGVLGGVAPG |
| 903 | MESTSTRPRGRPSSGGPAAGSAVVDRALALLEVLAAGDGATLSELGRRLGLAPSTTHRLLAALAARRLV EADPLTQLWHVGPGAFRLGAAFLRRGGLAERARPLMAQLAADSGETAVLAVADGDAALVVAESQAAGS LRVVLPPGARLAYHATAPGKALIAHLPLARVRALLGQGALPALTPRSFTDQGELTAELATLRHGGWLAER GESVPGQSGIAAPVFGGSGDPVAALGIIGPSVRLDDAALARLGPAVAAAAAGLGAALGGPALSPQTGKR |
| 904 | MQQPVRRRGRPRNSPSDAQATGIQSLNRALDVLEALARHEGITLTELAAHLDESPSTMYRVLATLEQRRY VESNPDKQEWFIAAEAFRLGSAFLRRTNIVERSRPVMRDLMARTGETSNLGIERDGDVLFVSQVETHETI RAFFPPGTRSPLHASGIGKALLGAFAEERLAGFLRTASFTRFTDRTVADAGQMQADIARTRSRGYAFDDE ERTVGMRCVAAAIINGHGEAVAGISVSGPTIRMPDQRVREIGGLVAMAAAEVSRLLGAPTPAPAAPAPAT DAPAVTPAVTPAVTPPVQG |
| 905 | MSDSPDQNTRARGRPRGWTDNTEQNTIKSLDRAMVVLERLSELESATLSQLASDLGQAPASIYRVLVTL QGRGIVGYETDGQIWHVGPTAYLIGSRFLRRTSLVERARPVLRRLMEQTGETANLGIRREGYVLFVSQVE THATIRAFFPPGTMSPMHASGIGKALLAYMPQDQRDRLLDGTELTQFTQFTCANRSDLESDLTHIRARGY SIDAEEKNLGMRCIAVPIFDVFGEAVAGISVSGPTSRVRVELTEDLATHVKSAGAELTHALGGTLP |
| 906 | MDSGNRRRGRPKGFGGAKPAATIQALDRALDVLDVLAGGDGLTLSELAGRLEQSVATMHRVLATLERRG LVEISADKQEWHVGAEAYRLGSAFLRRHNVVERSRSMMWTLMQETGETSNLGVEKDGNVLFVSQVETH ETIRAFFPPGSLSPLHASGIGKALLSTYAPARTERLFRGKTFARFTDKTIGSLDQLRDDVEATRRRGYAIDD EERSIGMRCVAAPILNVHGEAIAGISVSGPTHRLSDEKLRAIGERVRRGAAAVSRALGAPAATMTATPDAP GEPDQD |

FIG. 12BY

| | |
|---|---|
| 907 | MSQQDAAIRRGRPRQKTNGEVSAASPVSALDRGIRLLIALADTRGAALAELARSTEIPVATAHRLLTTLQH<br>RGMVVHDASQGKWRIGPQAYRIGSTFEEEANLLEVAPPVMRILSKETGETANLAIEEGGQLLYLIQVESEN<br>PIRASIKNGTDAYFHTSGVGKAIMAHLDTASLKRLLDPLTLVSQTPNSITEKQRLMAELDMSRQRGWALDD<br>EERSAGMRCIGAPVFDSLENVVAGVSISGPITRFPDDKLESLAASVVAAANSITNRLRNTPAGS |
| 908 | MEPPKRPRGRPKSLFKESSAGTMQSLDRALGVLTAVGEVERAALSDLSRATGVPTATTHRILSTLQKHGF<br>VAFDDERQEWMIGIEAYRTGASFLRRSSVLEVGRPILRRLMRQSGETANLAVPDGAEVVFIGQVETQNPI<br>RAFFPPGARTPMYASGTGKAILSALDETAVTTLMTRLDPVAFTEHTRLPGDDLLEDLAKTRARGWSHDRE<br>ERYYGMSCIGAAIFDNKAEPCAGVSVSGPTVRFGPDRAPELAALVTQAASEITELSGGQLPP |
| 909 | MKPTARRKGRPKAFDSKPTQTTIQSLDRALEVLDTLALENGMTLTEVSDRLKQSPATMYRVLSTLQARGF<br>VEIDAAAQTWHIGAMAFRLGSAFLRRSGVVDRSRPVMRDLMEATGETSNLGIERDGEVMFIGQVETTETI<br>RAFFPPGTLSPMHASGIGKALLSQRDADSLGRFLRTYPLNRFTDKTIGTAPALQAELTAIRQQGYAFDDEE<br>RTAGMRCVAAPILNLYGEAIAGISVSGPTHRMPADRIREIGRLVQQAANTVSRGLGAPEDT |
| 910 | MEEEVKRGRGRPKAWDDKGAQNTIKSLDRALEVLVQLGEMQGSTLSEIAGALGQSPATVYRVLTTFQGR<br>GFADFDPQSQVVWSIGPAAFLTGSMFLRRTSLVERARPIMRDLMEATGETANLGIERDGQVLFLGQVETH<br>ATIRAFFPPGTASAMHSSGIGKALLSRMDDKRQRAVLAAGKLEQFTPHTLTDPEAMIADLHTTKARGYAF<br>DGEERNIGMRCIAAPVYNVFGEAVAGISVSGPTSRITDDRIAALAEDVMEAAARLTRAIGGNNRPAS |
| 911 | MSTTLDDRKGERRGRGRPRGPAAATGSIQALDRALSVLQSLAAQGRVKLTDLALEVGIPTATAYRILTTLH<br>SRGFVDFEEATQSWKVGLEAYRTGSAYLVQTQLVDAARPAMRDLMEESGETANLAIPDGGEVVFIGQVE<br>TRNPIRAFFQPGTRTKMHASGTGKAILAAMSEAQVVQILTRQGLPQFTETTLVTKDALFADLHLTRERGW<br>SFDRDERHVGMSCIGAPIFNNRGDVRAGISISGPSARFDDGNIPLLGRRVRTAADWITQITGGTPPEIPAP |
| 912 | MSQPPRRKGRPKSFDSASQPATIQSLDRALDVLDALAGASGMTLTELSSALDQSAATMYRVLATLEARRI<br>VEMEPQSQTWHIGAMAFRLGSAFLRRSSVIERARPVMRELMEATGETSNLGIERGGDVMFVSQVETHES<br>IRAFFPPGTTSPMHASGIGKALLSCFGEDQLARFLRGRTLERFTEKTLTSAETLRADLAQIRNRGWSFDDE<br>EKAPGMRCVAAPVFGMQGEVLAGISISGPTARMPDGGIYGIGTLVKDAAQKLSQGMGAPAA |
| 913 | MPDPTPRKGRPRAFAGPGSQPTIQALDRALTVLDALAAADGLTLTELSRSLDQSTATVHRILATLEARQVV<br>EMDMQQQAWHIGAMAFRLGSAFLRRMSVIDRSRAAMRALMQDTGETSNLGIERNGEVMFVSQVETQES<br>IRAFFPPGTLSPMHASGIGKALLSRYPEDRLERFLRRRVLQRFNAQTITDPGALKTDLAQVRARGWALDD<br>EEKAAGMRCVAAPIVDIHGEAVAGISVSGPTQRMPPARIEEIGALVRGAAAEVSRGLGAPLSD |
| 914 | MDSQENAPKATRRARGRPRDWHDKTAQNTIKSLDRAMEVFEFLSEAQGKPLTMIAEEMGQSPATVYRIL<br>VTLEGRGLVEFDTEEQLWHIGARAFVIGARFLRRTSLVDRARPILRKLMEETGETANLGIEKEGHVLFLSQ<br>VETHASIRAFFPPGTLSQMHASGIGKALLAQMDVGRLDRLLATTRLEVFTDHTITDHEALKQDLTAIRAQG<br>FAVDNEEKNAGMRCIAAPVFDMNREAIAGISVSGPTSRISAQEITQLSRPVIEAAHALTLAIGGDVAS |
| 915 | MQPPLRKKGRPKAFNSDAAANPIQSLDRALIVLETLAGHSGLTLSEIAEKLDQSAATMYRVLTTLAARGFV<br>ESEPQTQEWHIGPASFRLGSAFLRRSSVVERARPVMRTLMEATGETANLGIEKDNMVMFVSQVETHESI<br>RAFFPPGTLSQMHASGIGKALLSLFPERRLERFLREQTLTDFTEKTLSDPDAIRAEMARSRAQGFAVDDE<br>EKNLGMRCVAAPITNFYGEAVAGISVSGPVSRMTSDRIPEVAALVKAAAGELSQGLGADTPNPEK |
| 916 | MDNQKRPRGRPKSLFKESSAGTMQSLDRALGVLTTVARLERAALSDLAREIDVPTATTHRILVTLQKHGF<br>VAFDDERQEWMIGIEAYRTGASFLRRNSVLEIGRPILRRLMQDSGETANLAVPDGSEVVFVGQVETPNPI<br>RAFFPPGARTPMYASGTGKAILAAMTETGLAKTLGAIDPVEFTANTQIPGDGLQQDLAKTRTRGWSHDRE<br>ERYQGMSCIGSAIFNDRGEPCAGISVSGPTARFGVDRAHVLGELVLAAAQEITHLSGGQTPKT |
| 917 | MNETKKPLRRGRPRLKANEEKAEVSLVVALDRGIQVLICLADRRCATLAELAKITAIPAATAHRLLTTQQR<br>GMVIHDAEKGKWRIGPQSYRIGSTFEEGSNLLEVAPAVMRLLSEETGETANLAVEEGGLLLFLVQVESEN<br>PIRASFKNGTAAHFHTSGVGKAIMAFMNEAALESFLTPQILVQQTPNSITDAQELKAELCKTRERGWALDD<br>EERFLGMRCIAAPIFDSLGKVVAGVSVSGPIARFPDHKLEGLATLVVKAAAATISDKLTHSSAGS |
| 918 | MKSKRGRPKAFHDTTEQNTIQSLDRALHVVNYVAQSPDRSLTEIATALEQSPATVYRVLVTLAGHQMVEM<br>DPAEQTWHIGAGAFRLGSAFLRRSSLVERARPVMRHLMERTGETANIGIEKNGRVLFLGQVETHESIRAF<br>FPPGTQAPMHTSGIGKAILSHFGPDRVHKIFESEAETYFTAHSLGTLDALTDDLALTRTRGFAVDNEERTL<br>GMRCIAAPIFNSEGEAIAGLSISGPVVRISQDRVPEISRAVTEAAHKLTEAIGGPAMPVES |
| 919 | MESHENENPGARRARGRPRGWDDKTAQNTIKSLDRAMEVYEFLSEAQGKALTTISTEMGQSPATVYRV<br>LVTLEGRGLVEFDPVEQVWHIGPQAFVIGARFLRRTSLVDRARPILRKLMEQTGETANLGIEKEGAVLFLS<br>QVETHASIRAFFPPGTLSPMYASGIGKALLAEMDDDRLARAMAFQELSAFTPFTITDADALRADLAQVRAN<br>GFSVDGEEKNLGMRCIAAPVFDVNAEAIAGISVSGPTSRVSPDDIDRLSAFVKDAAHALSLAIGGQADGRS |
| 920 | MPVEMRKRGRPKAFNGPQSQNTIQALDRALDVLEALATPEGMTLSKLADHLGQSTATMHRVLATLERRE<br>FVEISPDRQVVWHIGPEAYRLGSAFLRRSNVVERSRPIMRELMLETGETSNLGIEKGGHVLFISQVETHESI<br>RAFFPPGTLSPLHASGIGKALLSTYDGDRLTALFKTRELERFTENTVRSLDQLKEELQRTRERGYAFDDEE<br>RTWGMRCVAAPILNVHGEAVAGISVSGPKIRLQDADVHQIGERVRRAASMVSRRIGAP |
| 921 | MEKQCVKESGSVQSIHRALSILERLSASDEGLTLKEVAAQVSLPPSSAHRILTTLQRQRFVRFDQATMCW<br>SIGVQAFLVGNAFSRSRDMVALSIPFMRRLMLASGETVNFFMLDGSEVVCMAQVQSQQMVRAISRPGG<br>GAEMHRSAAGKMILAHMSDEEVAAIITRKGMARYTDHTITTQEALIQELARIRERGFSVDNEEFFTGLRCIA<br>APIYDETGSVYAAVSIAGPTSRITEARTQAMGELVEICARSITSEFGGSPTASKSRPGHSLHYPTARLS |

FIG. 12BZ

| | |
|---|---|
| 922 | MDSQENGSGAARRARGRPRGWTDKTAQNTIKSLDRAMEVFEYLSEAQGKPLTKLADEMRQSPATVYRI LVTLEGRGLVEFDHEEQVWYVGPRAFVIGARFLRRTSLVDRARPIMRKLMETTGETANIGKGQEDAVLFL SQVETHANIRAFFPPGSLSPMHASGIGKALLAYMEPERLDKLLSKGQMTRFTAHTIVDPAALRQNLEAIRE SGFSVDNEERNEGMRCIAAPVFDMNGEAVAGISISGPTSRVGASEVEELSRPVIKAAHELSLAIGGDVTRP QP |
| 923 | MEVFEYLSEAQGKPLTKLADEMRQSPATVYRILVTLEGRGLVEFDHEEQVWYVGPRAFVIGARFLRRTSL VDRARPIMRKLMETTGETANIGKGQEDAVLFLSQVETHANIRAFFPPGSLSPMHASGIGKALLAYMEPERL DKLLSKGQMTRFTAHTIVDPAALRQNLEAIRESGFSVDNEERNEGMRCIAAPVFDMNGEAVAGISISGPTS RVGASEVEELSRPVIKAAHELSLAIGGDVTRPQP |
| 924 | MLYFSYGELIFQNQKNELMTDLKSDSSATRRARGRPRAWDDKTEQNTIKSLDRAMAVFEHLSTQSGVSL SALSDQLGESTATLYRILFTLETRGLVEFDQAQQLWHIGPGAFIIGARFLRRTSLVERARPVLRSLMEQTG ETANLGVAQADQVLFVSQVETHESIRAFFPPGTLSPLHASGIGKALLAFMDEDQCKRILKQTDRERFTEHT LCDAALLATDLEAIRARGFSIDGEEKNLGMRCIAAPVFNHYGEAVAGLSVSGPTSRVSPDSIAPFAEAVKA AAAALTAALGGEIAPPQTKTVG |
| 925 | MPKPCIFHIVKVSFIENQRHLLESQDNPSKSPRRARGRPRDWEDKTAQNTIKSLDRAMMVLEFLSEGQGK PLSELAQDLQQSPATLYRVLTTLEGRGLVEFETETQAWHIGAQAFVIGARFLRRTSLVERARPILRRLMEQ TGETANLGVEKGGMVLFLSQVETHESIRAFFPPGTLSQMHASGIGKALLAEMEPSRLERVLKEHPLAEFT TQTITDAGHLRQDLLLIQDRGYAIDDEEKNLGMRCIAAPIFDMHQEAVAGLSVSGPTSRISRDHISEIGAVVI EAAAEVSSAIGGQALRR |
| 926 | MPKLPDSEIPRTRGRPRAFNEKTEQNTIKSLDRALGVLKELAQIESATLSELATAMKESPATLYRVLTTFAL HGIVEMDETAQTWHIGSEAYQIGSAFLRRTSLIDVSRPILRKLMQETGETANLGIEKNGSVFFMSQIETNAP IRAFFPPGTLSEMHASGIGKALLAHMDETQLKRFAARGLQTFTPHTLATPESLAADMVTTRERGYALDDQ EKNLGMRCIAAPIQDAYGEVIAGISVSGPTTRVSTDHIETLAKSVMRAAQDVSNALGAKTSEPS |
| 927 | MQQTVRKRGRPKGAKPTQPAASIQALARSLDVLEALASHDGVTLTELSKYLDQSPATLHRILATLENRRY VESNTERQEWFVGPEAFRLGSAFLRRTNIVERSRPVMRDLMARTGETSNLGIERDGDVLFISQVETHDTI RAFFPPGTRSPLHASGIGKALLSAFDDDRLEAFLKTATFTRFTDKTIANIKELRESIQQTRRLGYSVDDEER TIGMRCVAASIVNSYGEAVAGISVSGPTIRMPDKRVREIGQLVSDAANEISLQLGSPLLNLPRHRD |
| 928 | MSVQVRKRGRPRGRAGGFGAEDSGGIRALDRALDILDLIAASNGLTLTEIAQRLEMAPSTVHRVLVTLAA RGVAESDSQTQAWHVGPTAFRHGSAFMRRSGLVERARPLLRRLMEVTGETANLGILNGDAVLFLSQAET HETIRAFFPPGTRSALHASGIGKALLAHASMMDLKRMLREMRLERFTGMTLTDPQALLEDLARIRARGYA LDNEERTPGMRCIAAPIFDLAGEAAAGISVSGPTLRMSDERLAAMSEAVIAAARELSFGAPPAADGG |
| 929 | MPQPPRRKGRPKSFDSASQPATIQSLDRALDVLDALAAANGMTLTELSSALGQSAATMYRVLSTLEVRQI VEVEPQSQTWHIGAMAFRLGSAFLRRSSVIERARPVMRELMEATGETSNLGIERGGDVMFVSQVETHES IRAFFPPGTTSPMHASGIGKALLSCFGEDQLTRFLRGQALERFTEKTLTSAEALRADLAQIRSRGWSFDDE EKAPGMRCVAAPVFGMQGEVLAGISISGPTARMPDGGINGIGALVKDAAEKLSYGLGAPAAVETPPG |
| 930 | MDSQENAPKATRRARGRPRDWHDKTAQNTIKSLDRAMEVFEFLSEAQGKPLTMIAEEMGQSPATVYRIL VTLEGRGLVEFDTEEQLWHIGARAFVIGARFLRRTSLVDRARPILRKLMEETGETANLGIEKEGHVLFLSQ VETHASIRAFFPPGTLSQMHTSGIGKALLAQMESSRLDRLLATTRLEAFTDHTITDHEALKQDLATIRAQGF AVDNEEKNAGMRCIAAPVFDMNREAIAGISVSGPTSRISAQEISQLSRPVIEAARALTLAIGGDVTP |
| 931 | MESQDNGPGGVRKARGRPRDWHDKTAQNTIKSLDRAMEVFEFLSERQGMALSTISDEMRQSPSTVYRI LVTLETRGLVEFDAEEQLWHIGPRAFTIGARFLRRTSLVDRARPAMRRLMEMTGETANLGVEKESAVLFL SQVETHATIRAFFPPGTLSPMHASGIGKALLAQMEEDRLSRWLAGRGRLEAFTERTITDPDRLRQDLKQI RTRGYAIDDEEKNAGMRCIAAPVFDITGEAVAGISVSGPTSRVTREQTESLSRPVMEAARTLTQSIGGVVI PPRS |
| 932 | MQVVKRRRGRPKAFNSPESPSVIQSLDRALDVLEALASPEGLTLSQLAAHLGQSVATMHRVLSTLERREF VEISPDRQVWHIGPEAYRLGSAFLRRTNVVERSRPIMRELMLETGETSNLGIEKDGHVLFISQVETHESIR AFFPPGTLSPLHASGIGKALLSTYDDSRL |
| 933 | MEAKGKGKRGRKAGENAAPASVQVLDRSLSLLAIIAEGDGSTLTALSERSGMAPSTVHRLLTSLAQHEMV ANDAEAGTWTVGVKAFEIGNAFLRFRKLGTISRPFLKRLMDESGETANIGIEEDGDVVFISQVESHAPMRA FFRPGRRGPIHASGIGKAILSTWSDTEIAKTLSGRTLACFTGRTLATLPDLIRNVQEIRFRGWSVDDEEHTL GMRCIAAPLFNEYGEAIGGISISGPTVRIDDERLGVLGPAVRRMADELTRAIGGHRPEEG |
| 934 | MTQTKRPRGRPKSQFADSSAGTMQALDRALAVLTAVARQEGVNLTDLSLSLGIPTATTHRILTTLQKRDF VRFDEERQDWTIGIEAYRTGVAYLKRTNLADAGRPVMRRLMEQTGETANLAVPDGAEVVFIGQVETQNPI RAFFPPGSRTPMHASGTGKAILAALPEDRLMALLKGAGLKGFTEDTLITPRALFDDLAETRRRGWSFDRN ERYDGMSCIGAAIFNDRGEPCAGVSISGPSSRFRDAQIAEFGAAVAQAAAQITHLIAGHGLMPGQ |
| 935 | MPGEPRRRGRPKAFNGPQTQNTIQALDRALDVLDALATPEGKTLSELASQLDQSAATMHRVLATLERRE FVEISPDRQVWHIGPEAYRLGAAFLRRSNVVERSRPIMRELMLETGETSNLGIEKDGNVLFISQVETHESI RAFFPPGTLSPLHASGIGKALLSTYDEDRLSTLFKKKEFERFTDNTVRSFEQLREELQKTRERGYSFDDEE RTKGMRCVAAPILNVHGEAVAGISVSGPIHRLPDADINQIGERVRSAARMVSRRLGAP |

FIG. 12CA

| | |
|---|---|
| 936 | MPQEPRRRGRPKAFNGPQTQNTIQALDRALDVLDALATPEGKTLSELAGQLGQSAATMHRVLATLERRE FVEISPDRQVWHIGPEAYRLGAAFLRRSNVVERSRPIMRELMLETGETSNLGIEKDGNVLFISQVETHESI RAFFPPGTLSPLHASGIGKALLSTYDEDRLSALFRKKEFERFTENTVRSFEQLREELQKTRERGYSFDDE ERTKGMRCVAAPILNVHGEAVAGISVSGPIHRLPDADIHQIGERVRSAARMVSRRLGAP |
| 937 | MDSGNRRRGRPKGFGGAKPAATIQALDRALDVLDVLAGGDGLTLSELAGRLEQSVATMHRVLATLERRG LVEISADKQEWHVGAEAYRLGSAFLRRHNVVERSRSMMWTLMQETGETSNLGVEKDGNVLFVSQVETH ETIRAFFPPGSLSPLHASGIGKALLSTYAPARTERLFRGKTFARFTDKTIGSLDQLRDDVEATRRRGYAIDD EERSIGMRCVAAPILNVHGEAIAGISVSGPTHRLSDEKLRAIGERVRRGAAAVSRALGAPAATMTATPDAP GEPDQD |
| 938 | LAVAVVSEQAKGKRGRKAGANSTPSSVQVLDRSLALFSLVADRDGSTLTDLADETGLAPSTIHRLLTSLS SHGMVAHDPDTGEWTIGVRAFEIGNAFLRFRKLGTISRPYKRLMDESGETANIGIEDDGDVVFISQVESH APMRAFFRPGRRGPSHASGIGKAILSTWSDTEIAKTLGGRTLTHFTDRTLDTLPALIRNIQEIRNRGWSIDD EEHTLGMRCIAAPLFNEYGEAIGGISISGPSVRIDDNRLEPLGSLVRRTADELTRAIGGHRPGEG |
| 939 | MQVVKRRRGRPKAFNAPESSNVIQSLDRALDVLEALASPEGLTLSELAAHLGQSAATMHRVLSTLERREF VEISPDQQVWHIGPEAYRLGSAFLRRTNVVERSRPIMRELMLETGETSNLGIEKDGNVLFISQVETHESIR AFFPPGTLSPLHASGIGKALLSTYDDSRLASLFKKTTLERFTANTVRSVAQLEEELRVTRDRGYAFDDEER TKGMRCVAAPILNVHGEAVAGISVSGPTHRMPDRQVQEIGERVRNAAKMVSRRLGAP |
| 940 | MDFQDNAGRGTRKARGRPRDWDDKTAQNTIKALDRAMEVFEFLSERQGMALSAISAEMGQSPSTVYRV LVTLENRGLVEFDAGEQLWHIGPRAFMIGARFLRRTSLVDRARPVMRALMEATGETANLGVEKEGMVLF LSQVETHANIRAFFPPGTLSAMHASGIGKALLAQMDDARLARRLGDGLEAFTKKSIIDYGALLADLRETRT RGYSYDDEERNIGMRCIAAPVFDINGEAIAGISVSGPTSRLTGDGLERLSRPVMEAARTLTEAIGGSITPQR T |
| 941 | MSLEVRKRGRPRGRAGGPGAEDSGGIRALDRALDILDLIAGSSGLTLSEIGQRLEMAPSTVHRVLVTLAA RGVAESDPTTQAWHVGPTAFRHGSAFMRRSGLVERARPLLRRLMEQTGETANLGILNGDAVLFLSQAET YETIRAFFPPGTRSALHASGIGKALLAHVRPGELRLMLAEMRLQRFTDKTLCEPRALQEDLARIRERGYSL DNEERTPGMRCIAAPIFDLAGEAAAGISVSGPTLRMSDARLESMSAAVVAAAKELSLGMAPAGGPMRES |
| 942 | MDSPKDAETSPRRARGRPRGWEDNSAQNTIKSLDRAMAVLDYLSAHPGLTLSELAGDLKQSPATVYRIL VTLEGRRLVEFDSAEQLWHIGPQAFVIGARFLRRTSLVERARPVLRGLMEETGETANLGIVREASVLFVS QVETHESIRAFFPPGTLSPLHASGIGKALLAEMAGERLEKLLARKMERFTAHTLAEPEALRADLSAIRARG YSIDAEEKTLGMRCIAAAVFDASGEAVAGISVSGPTIRMREDMTDTTSRAVMRAAQELTAAIGGVTPPVR |
| 943 | MPSDTAPDPQNRRARGRPRGWDDKTEQNTIKSLDRAMLVFEHLSRSQGKMLTELADDLNQSPATVYRV LVTLETRGLVEFDPAEQLWHIGPQAFVIGAGFLRRTSLVERARPILRRLMEVTGETANLGRELDGQVLFLS QVETNATIRAFFPPGTLAEMHSSGIGKVLLAQMSEERIARILADHPMQAFTPNTITDPATLSRELATIRAQG FAIDAEERNEGMRCIAAPVFDHSQSAVAGLSVSGPTSRVSEEKTDEFSHAVIQAARDLSAALGGLP |
| 944 | MDFQDNPVRRARGRPRAFDARTEQNTIKSLDRALMVLDELSHMESASLSELAQGLEESPATVYRILSTFA LHGVVEVDAAQQTWHIGADAFRIGSAFLRRTSLVERSRAVLRGLMKTTGETANLGVEKDGAVLFVSQVE THAPIRAFFPPGTLSPLHASGIGKVLLAHAPAGRLEQVAAKGLESFTPHTLADLGRLRADLDLIRARGHAV DDQERNLGMRCIAAPIRNVHGEVVAGISVSGPTSRVSPDHVPDLARAVIAAAAEVSAAIGAPGG |
| 945 | MQNPNRRRGRPKSFNEPQSSSVIQSLDRALDVLEALASPEGMTLSELSAHLDQSPATMHRVLATLERRE FVEISPDRQVWFIGPEAYRTGAAFLRRSNVVERSRPIMRELMLETGETSNLGIEKDGNILFISQVETHESIR AFFPPGTLSPLHASGIGKALLSTYDDDRLSALFKTSTLKRFTENTARSVAQLKEELIVSRERGYAIDDEERT KGMRCVAAPILNVHGEAVAGISVSGPTHRMPDRLIRQIGERVTGAAKTVSRRLGGG |
| 946 | MESPENGGRGPRRARGRPRGWDDKTEQNTIKSLDRAMEVFEFLSEAQGKALTAIAGEMGQSPATVYRIL VTLEGRGLVEFDAEEQLWHIGPRAFVIGARFLRRTSLVERARPVLRRLMEATGETANLGVGRDASVLFLS QVETEASIRAFFPPGTLSPMHASGIGKALLAHMDEDRLARVLKVAVLTAFTDHTLTDAEALRQDLGVIRTR GYSIDNEEKNAGMRCIAAPIFDMHGEVTAGLSVSGPTSRIGLDQVAPLSGHVLAAAHDLTAAIGGVTPPRN |
| 947 | MQQTVRKRGRPKGAKPTQPAASIQALARALDVLEALASHDGVTLTELSNYLDQSPATLHRILATLENRRY VESNTERQEWFVGPEAFRLGSAFLRRTNIVERSRPVMRDLMARTGETSNLGIERDGDVLFISQVETHDTI RAFFPPGTRSPLHASGIGKALLGAFDDDRLEAFLKTATFIRFTDKTIANIKELRESIQQTRRLGYSFDDEER TIGMRCVAASIVNSYGEAVAGISVSGPTIRMPDKRVREIGQLVSDAANEISRQLGSPLLSLPRHRD |
| 948 | MSQPPRRKGRPKSFDSASQPATIQSLDRALDVLDALAGASGMTLTELSSALDQSAATMYRVLATLEARRI VEMEPQSQTWHIGAMAFRLGSAFLRRSSVIERARPVMRELMEATGETSNLGIERGGDVMFVSQVETHES IRAFFPPGTTSPMHASGIGKALLSCFGEDQLARFLRGRTLERFTEKTLTSAETLRADLAQIRNRGWSFDDE EKAPGMRCVAAPVFGMQGEVLAGISISGPTARMPDGGIYGIGTLVKDAAQKLSQGMGAPAA |
| 949 | MDTGNRRRGRPKGFGGAKPTATIQALDRALDVLDVLAGGDGLTLSELAGRLEQSVATMHRVLATLERRG LVEISADKQEWHVGAEAYRLGSAFLRRHNVVERSRSMMWTLMQETGETSNLGVEKDGNVLFVSQVETH ETIRAFFPPGSLSPLHASGIGKALLSTYAPARTERLFRGRTFARFTDKTIGSLDQLRDDVEATRRRGYAIDD EERSIGMRCVAAPILNVHGEAIAGISVSGPTHRLSDEKLRAIGERVRRGAAAVSRALGAPAATTEAPDEPG RD |

FIG. 12CB

| | |
|---|---|
| 950 | MESQNNAGISHRKARGRPRDWDDKSAQNTIKSLDRAMEVFEFLSEAQGKTLTMLANDLSQSPATVYRIL VTLEGRGLVEFDQIDQVWHVGPRAFIIGSRFLRRTTLVDRARPILRTLMEQTGETANLGIEQNGHVLFVSQ VETHASIRAFFPPGTLSRLHASGIGKALLSQMEDARVDKFLTDMPLESFTEFTLTQPDALKADLELTRQRG YSIDGEERNVGMRCIAAPVFDIHGEAIAGISVSGPTSRVGTEEIANLSTSVLSAARELSAAIGGVAPAAR |
| 951 | MDSQDNAGISQRKARGRPRDWDDKSAQNTIKSLDRAMEVFEFLSEAQGKTLTMLANDLSQSPATVYRIL VTLEGRGLVEFDQDDQVWHIGPRAFVIGARFLRRTSLVERARPVLRSLMEDTGETANLGIEQNGHVLFVS QVETTASIRAFFPPGTLSRMHASGIGKALLAEMEEHRISKLLSKAPLEGFTEFTLTDHTALLEDLRLSKARG YAIDGEERNLGMRCIAAPVFDINGEAIAGISVSGPTTRVGADQVAALSEAVVAAASRLTNAIGGAAVPAR |
| 952 | MQAPKRQRGRPKSQFTESSAGTLQSLDRALSVLVALSRAGRMTLSDLALAVGVPTATTHRILMTLQKHD FVAFDEDRQDWLIGIEAFRTGAAFLKRSNLVEIGRPVMQLLMEETGETANLAVPQKAEVVFVGQIETLNPI RAFFPPGTRTAMHASGTGKAILADLPEDKVKRLLSAAGLERFTANTRTTPADLFADLARTRARGWSFDRE ERYESMSCIGATIFDEMGNPCAGVSISGPSIRFDEDRIAAFGTAVKNAADEITRRLGGLPPERAR |
| 953 | MTQPRPRGRPRAFHDKTDQNTVRALDRAMGLLTALSETKGLTLSELAALSNQSPATVYRVLITLQGHDIV ELEEEAQRWHVGPGAFRIGSGFLRRTNVAERSRGAMQALMRATGETANLGVEDRDEVLFLTQVETHETI RAFFSPGTRGPMHCSGIGKALLAFLPAARVAAILETQGLPGFTPRSITSETGLHADLDRTRARGYAIDDQE RAEGMRCIAAPIFNAHGEPIAGLSVSGPAFRIPLDAADGIGAEVRAAADRVTAATGGISPTEKSA |
| 954 | MNTQKRPRGRPKSQFKESTAGTMQSLDRALGVLVAVAKSEQATLTDLSLSLGVPTATTHRILTTLQKHRF VAFNEEHQSWSIGIEAYRTGASFMNRTSLTEVSRPIMRLLMEKTGETANLAIPDGAEVVFVEQIETLHPIRA FFARGARTSMHASGIGKAILSTMSEEHVRRLLISSGLQAFTDNTLTSPASLFADLTETRARGYSYDREERY LGMSCIGSAIFDERGEACGGVSISGPSTRFDSLRVPELGAIVAEAAGQISQLIGGRGREPASSLPASNTPT A |
| 955 | MPQPPRRKGRPKSFDSASQPATIQSLDRALDVLDALAGASGMTLTELSSALDQSAATMYRVLSTLEARQI VEMEPQSQTWHIGAMAFRLGSAFLRRSSVIERARPVMRELMEATGETSNLGIERGGDVMFVSQVETHES IRAFFPPGTTSPMHASGIGKALLSCFEDDQLTRFLRGRALERFTEKTLTSAEALCADLAQIRQRGWSFDDE EKAPGMRCVAAPVFGMQGEVLAGISISGPTARMPDGGISGIGALVKDAAQKLSYGLGAPAADETPPG |
| 956 | MNAEAPPERRSRGRPRAWGDTTEQNKIKSLDRALMILERLGERGGATLTDLAEDLKQSPATVYRVLFTFE ARGIVDFDPSAQTWHIGAGAFQIGSRFLRRTSLVERARPFLRELMQRTEETANLGMMRDGQVLFLSQVE THHNIRAFFPPGAMSDMHASGIGKALLAQLPDKDVASIIRARKLSRFTDETLVTPEALAADLEQTRRRGYA FDKEEKNPGMRCIAAPVFDMHSEPIAGVSISGPSARIPDERVEELARAVQHAATQLTEALGGTPP |
| 957 | MPDPKMEATATRRARGRPRSWDDKSGQNTIKSLDRAMSVFEHLSTQRGVSLSALSDQLGESTATLYRIL FTLETRGLVEFDQAEQLWHIGSGAFIIGARFLRRTSLVERARPILRKLMEDTGETANLGVSQSHQVLFVSQ VETHSNIRAFFPPGTLSPMHASGIGKALLAFMDPDLCERIVSRGQMERFTEHTLCDAEGLMADLEQIRKR GYSIDGEEKNVGMRCIAAPVFDHFGEAVAGLSVSGPTSRVSQDKIDTLSVGVMAAAEALTSAIGGDVTRQ RS |
| 958 | MTEKQATIRRGRPKRTERDPDTAGPTILALDRGLNALIFLADNQNATLTEISRGTNTPVATAHRILTTLQQR GMVLFNENEGNWTVGAQAFRVGNAYQAGSNLMAAATPVMEELSQLTGETANLAIEDSGELLYLIQVESN NPIRASLKNGAASYFHTSGVGKALLAYKDKTQLERFLKGRSLVRQTSKSITDHDLLKSELIRIKEMGWALD DEERYMGMRCIAAPVYDPLGQAMAGVSISGPSSRFPDDQLQNLASKVQNAAGRISKSLESSDF |
| 959 | MSSPPRQRGRPKSFHSKQAQNTIQSLDRAIDVLEHLAQHGSQTLTEISTSMEQSPATIYRVLTTFEARGLV ETEGLSQVWAIGPATFRIGSSFLRRTSLVERARPAMRSLMETTGETANLGIRTGANVIFISQVETHHSIRAF FPPGTISAIHASGIGKALLSAMSEESVRELLKRSSLEAFTRNTMSDLDALCADLQISRDRGFALDDEERTE GMRCIAAPIRDLNGDTVAGVSISGPSHRMKPSVVKEFGTLVKTVGENLSSSLGAP |
| 960 | MPSDTAPDPQNRRARGRPRGWDDKTEQNTIKSLDRAMLVFEHLSRSQGKMLTELADDLNQSPATVYRV LVTLETRGLVEFDPAEQLWHIGPQAFVIGAGFLRRTSLVERARPILRRLMEVTGETANLGRELDGQVLFLS QVETNATIRAFFPPGTLAEMHSSGIGKVLLAQMSEERIARILADHPMQAFTPNTITDPATLSRELATIRAQG FAIDAEERNEGMRCIAAPVFDHSQSAVAGLSVSGPTSRVSEEKTDEFSHAVIQAARDLSAALGGLP |
| 961 | MLESAPKKRARGRPKAFNDKSEQNTVQSLERALSVLKHLAEQRGIALSDLAKETDQSPATLYRILTTFQLH QMTEFDENEQLWHIGAGAYRVGANYLRRTSVVERSRPVMRQLMQDTGETANLGVEQADMVLFVSQVE THESIRAFFPPGTQSKMHASGIGKALLAYYPPERLDQWFLQQRLTRYTDATITDPDVLRQELADIRVTGLS FDNEEKNIGMRCIASPVFDGFGEPVAGLSVSGPSSRMTDAMIDAIGAHVKAAAARVTEAVGGQPPER |
| 962 | MDSPKDAETSPRRARGRPRGWEDNSAQNTIKSLDRAMEVLDYLSAHPGLTLSELAGDLRQSPATVYRIL VTLEGRRLVEFDPAEQLWHIGPQAFVIGARFLRRTSLVERARPILRALMEETGETANLGIVREASVLFVSQ VETHESIRAFFPPGTLSPLHASGIGKALLAEMAGERLEKLLARKMERFTAHTLAEPEALRADLAAIRARGY SIDAEEKNLGMRCIAAAVFDASGEAAAGISVSGPTIRMREDMTDETSRAVMRAARELTSAIGGVTPPER |
| 963 | MKRPVIAAEPPKRGRGRPRLQHSDTEVSVVQALDRGLTLLQILAREGAVNLTDLSLQAGMPAPTAHRLLT TLMRQQFAAYNESTQMWTVGVQAYSVGSSYLARTSLVELAKPVMRTLMEETGETANLAVTEGGYVVFL SQVESNHPIRAYHRPGSRSHLHVSGIGKALLACRSKSEVEKILQKRGLPAFTPHTLSSPSALFENLELTRQ RGWSFDNEEHFEGMRCVAAAITDAQGESLAGISVSGPSTRFPENHVAEIGPKVQRAAEQISRELGA |

FIG. 12CC

| 9 6 4 | MSDLQNAQESPRRARGRPRGWDDKTEQNTIKSLDRAMEIFEYLSTDQGKTLSQLASELNQSPATVYRVL<br>ITLEARGLVEFDAEEQRWYIGARAFVIGARFLRRTSLVDRARPILRALMERTGETANLGIEKGGMVLFLNQ<br>VETHESIRAFFPPGTLSDMHASGIGKALLAFMDEDRFGRWLRGRSFETFTAHTLVAPDALVQELHRTRVR<br>GYAIDAEEKNLGMRCIAAPVFDMYGEAVAGISVSGPATRMGSDVTDRISRSVVDAASELTRAVGGADRH<br>AVG |

METHOD OF PRODUCING AUTOTROPHIC ORGANISMS WITH ALTERED PHOTORESPIRATION AND IMPROVED $CO_2$ FIXATION

CROSS-REFERENCE TO RELATED APPLICATIONS

This is a U.S. National Phase of International Application No. PCT/EP2019/059715, filed Apr. 15, 2019, which claims priority to European Application No. 18167406.0, filed Apr. 15, 2018, the contents of which are incorporated herein by reference.

INCORPORATION BY REFERENCE OF THE SEQUENCE LISTING

This application contains, as a separate part of disclosure, a Sequence Listing in computer-readable form (filename: 56079_SubSeqListing.txt; 2,732,626 bytes—ASCII text file, created: Nov. 29, 2022) which is incorporated by reference herein in its entirety.

FIELD OF THE INVENTION

The present invention relates to autotrophic microorganisms with altered photorespiration and improved $CO_2$ fixation as well as a method of producing said autotrophic microorganisms. Particularly, the autotrophic microorganisms show an improved growth rate, productivity and energy conversion efficiency.

BACKGROUND OF THE INVENTION

Biological fixation of $CO_2$ is an important process carried out by plants and a number of microorganisms, which can be harnessed for sustainable, biobased production of fuels and chemicals. Particularly, the fixation of $CO_2$ by autotrophic microorganisms such as cyanobacteria and microalgae can be employed for converting $CO_2$ into value-added products, such as commodity chemicals or fuels. However, the sustainable autotrophic production of chemicals and fuels is still limited due to the low growth rate, productivity and energy conversion efficiency of autotrophic microorganisms.

One major energy loss occurs during the fixation of $CO_2$ in both photoautotrophic and chemolithoautotrophic microorganisms, which employ the relatively inefficient Calvin-Benson-Bassham cycle for $CO_2$ fixation (Zhu et al. Annu Rev Plant Biol 2010, 61, 235). The $CO_2$ fixation is catalyzed by the enzyme ribulose-1,5-bisphosphate carboxylase (RubisCO) which is located inside the chloroplasts in plants and other eukaryotic organisms. The enzyme RubisCO catalyzes two reactions: carboxylation and oxygenation of ribulose-1,5-bisphosphate. The product of the first reaction are two molecules of 3-phosphoglycerate which enter the CBB cycle to form higher carbon compounds and ribulose-1,5-bisphosphate. The products of the oxygenase reaction are each one molecule of 3-phosphoglycerate and 2-phosphoglycolate. The latter is converted to 3-phosphoglycerate in a biosynthetic pathway named photorespiration. In the course of this complex sequence of reactions one molecule of $CO_2$ is released at the expense of cellular energy in form of ATP and NAD(P)H equivalents and lost for the microorganism. Furthermore, $NH_3$ is released which has to be refixed. This loss of $CO_2$ in the photorespiration pathway is one major reason for the low growth rate, productivity and energy conversion efficiency of autotrophic microorganisms.

Many attempts have been made to implement alternative natural and synthetic photorespiration pathway in microorganisms and plants in order to improve the $CO_2$ fixation (see Claassens, Microbial Biotechnol 2017, 10, 31). However, the pathways implemented so far have major drawbacks. Some pathways are mainly limited to anaerobic settings, due to oxygen-sensitive enzymes, and they require high $CO_2$ concentrations to be thermodynamically feasible (Berg, Appl Environ Microbiol 2011, 77, 1925). Among the recently introduced natural pathways in microorganisms, the complete natural 3-hydroxypropionate bi-cycle in *Escherichia coil* does not provide a completely functional pathway (Mattozzi et al., Metab Eng 2013, 16 130) and the section of the natural 3-hydroxypropionate/4-hydroxybutyrate cycle in the heterotrophic thermophile *Pyrococcus furiosus* could not provide complete autotrophic growth due to the insufficiency of the short sequence (Keller et al., Proc Natl Acad Sci USA 2013, 110, 5840).

WO2003/100066A1 discloses the re-use of 2-phosphoglycolate produced in photorespiration in a pathway that converts 2-phosphoglycolate into 3-phosphoglycerate. Further, WO2009/103782A1 describes the conversion of glycolate into malate. However, similar to other alternative photorespiration routes, also the pathways disclosed in WO2003/100066A1 and WO2009/03782A1 result in the release of $CO_2$ and therefore do not remedy the major deficit of natural photorespiration. WO2016/207219A1 reports on the conversion of 2-phosphoglycolate into an intermediate compound of the Calvin-Benson-Bassham Cycle. WO 2015/120343 A2 discloses methods and compositions for introduction of a synthetic pathway based on the 3-hydroxypropionate (3OHP) bicycle into host organisms such as cyanobacteria, plants or algae. The heterologously expressed pathway acts as a photorespiratory bypass as well as an additional carbon fixation cycle orthogonal to the endogenous Calvin-Benson cycle (CBC). Shinoda et al. (Biochem Biophys Res Commun. 2007, 355(3), 782-7) describe a Glu141Asn/Gln313Glu double mutant formate dehydrogenase (FDH) from *Paracoccus* sp. 12-A. It was shown that the two mutations convert FDH to a highly specific and active glyoxylate reductase.

Therefore, it is the objective of the present invention to provide autotrophic microorganisms with altered photorespiration and improved $CO_2$ fixation as well as a method of producing said autotrophic microorganisms, thereby increasing the growth rate, productivity and energy conversion efficiency of autotrophic microorganisms.

The objective of the present invention is solved by the teaching of the independent claims. Further advantageous features, aspects and details of the invention are evident from the dependent claims, the description, the figures, and the examples of the present application.

DESCRIPTION OF THE INVENTION

The present invention is directed to a method for the production of autotrophic microorganisms with altered photorespiration and improved $CO_2$ fixation comprising introducing into the autotrophic microorganism one or more nucleic acids encoding polypeptides having the enzymatic activities of
  (i) phosphoglycolate phosphatase,
  (ii) glyoxylate reductase,
  (iii) erythro-β-hydroxyaspartate aldolase, (iv) erythro-β-hydroxyaspartate dehydratase,
(v) iminosuccinate reductase and
(vi) aspartate-glyoxylate transaminase,
wherein the introduction of the nucleic acid(s) results in a de novo expression of polypeptides having the enzymatic activities of
(i) phosphoglycolate phosphatase,
(ii) glyoxylate reductase,
(iii) erythro-β-hydroxyaspartate aldolase,
(iv) erythro-β-hydroxyaspartate dehydratase,
(v) iminosuccinate reductase and
(vi) aspartate-glyoxylate transaminase.

The method of the present invention relates to the bypass of the naturally-occurring photorespiration pathways in autotrophic microorganisms with the β-hydroxyaspartate pathway (BHAP), which was elucidated by the inventors in proteobacteria, such as in *Paracoccus denitrificans*.

The β-hydroxyaspartate pathway as shown in FIG. 1 comprises the conversion of two units glyoxylate (C2) to one unit oxaloacetate (C4), which can be further metabolized in the tricarboxylic acid (TCA) cycle, under consumption of one unit of the cofactor NADH. In contrast to the natural photorespiration pathways as listed in Table 3, no $CO_2$ is released, no ATP and only 1 equivalent of NADH is required. The BHAP represents a $CO_2$ neutral photorespiration bypass pathway with the least amount of required reducing equivalents and the regeneration of the catalytic amino donor, which makes it the most efficient glyoxylate assimilation pathway described to date. Thus, the BHAP may lead to an increased growth rate, productivity and energy conversion efficiency, when implemented into autotrophic microorganisms.

In the BHAP, the enzyme (iii) β-hydroxyaspartate aldolase 2 catalyzes the condensation of glycine and glyoxylate to (2R,3S)-β-hydroxyaspartate and the enzyme (iv) β-hydroxyaspartate dehydratase 3 catalyzes the subsequent dehydration to iminosuccinate. The iminosuccinate is reduced to aspartate by the (v) iminosuccinate reductase 4 in the presence of the cofactor NADH and the formed aspartate is finally converted with glyoxylate to oxaloacetate and glycine in the presence of the enzyme (vi) aspartate-glyoxylate transaminase 1. Oxaloacetate formed in the BHAP can directly enter the tricarboxylic acid cycle or serve as substrate for anabolic reactions.

It was generally assumed that the product of the dehydration of (2R,3S)-β-hydroxyaspartate is oxaloacetate (Biochem. J. 1965, 97(2), 547). However, the inventors could show that the reaction product of the (iv) β-hydroxyaspartate dehydratase enzyme is actually iminosuccinate, a compound that is highly labile in aqueous solution and is reduced to aspartate by the newly identified iminosuccinate reductase. A crystal structure of the newly identified iminosuccinate reductase is disclosed herein (see Example 6).

The BHA pathway is essential for growth of proteobacteria such as *P. denitrificans* on glycolate and glyoxylate. As shown in FIG. 4, all four enzymes of the BHAP are highly expressed and active in glycolate-grown cells compared to acetate-grown cells, while the expression level of the adjacent transcriptional regulator (BHAR) is negatively affected with increasing concentrations of glyoxylate (see FIG. 5b). This suggests that either glycolate or a downstream reaction product thereof specifically induces expression of the enzymes of the BHAP.

The inventors have successfully integrated the four genes of the BHAP at two different neutral sites of the chromosome of *S. elongatus* PCC7942 (see Example 5). This was done both in the wild type strain and in a deletion strain that lacks the genes necessary for the formation of carboxysomes (ccmK-O), and therefore requires elevated atmospheric $CO_2$ concentrations for growth (this strain is henceforth referred to as ΔK-O). As shown in FIG. 7, the activity of each single enzyme in the ΔK-O strain was at least 300 mU/mg, while the reaction sequence from glycine and glyoxylate to aspartate (via BHA aldolase, BHA dehydratase and iminosuccinate reductase) was measured at an activity of ~100 mU/mg, notably without any additional coupling enzymes, thereby verifying the successful expression of the pathway enzymes as well as the maintenance of the enzyme activity. The expression level of the BHAP enzymes is high enough to sustain photorespiratory flux in *S. elongatus* PCC7942 ΔK-O.

In addition, the inventors could show in growth experiments that the implantation of the BHAP in microorganisms permits a more than 20% faster growth of the microorganism at 30° C. and 37° C. (see Table 4 and FIGS. 8 and 9) compared to the ΔK-O control strain. Therefore, it was successfully demonstrated that the bypass of the naturally-occurring photorespiration pathways in autotrophic microorganisms with the β-hydroxyaspartate pathway (BHAP) by the inventive method results in a faster growth of the autotrophic microorganisms.

DETAILED DESCRIPTION OF THE INVENTION

Definitions

Throughout this specification amino acid residues will be denoted by the three-letter abbreviation or single-letter code as follows:

| Amino Acid | Three-letter abbreviation | One-letter Symbol |
|---|---|---|
| Alanine | Ala | A |
| Arginine | Arg | R |
| Asparagine | Asn | N |
| Aspartic Acid | Asp | D |
| Cysteine | Cys | C |
| Glutamine | Gln | Q |
| Glutamic Acid | Glu | E |
| Glycine | Gly | G |
| Histidine | His | H |
| Isoleucine | Ile | I |
| Leucine | Leu | L |
| Lysine | Lys | K |
| Methionine | Met | M |
| Phenylalanine | Phe | F |
| Proline | Pro | P |
| Serine | Ser | S |
| Threonine | Thr | T |
| Tryptophan | Trp | W |
| Tyrosine | Tyr | Y |
| Valine | Val | V |

"Iminosuccinate reductase" as used herein refers to a polypeptide having an iminosuccinate reductase activity, i.e. an iminosuccinate reductase catalyzes the reaction of iminosuccinate (or iminoaspartate) to aspartate in the presence of a cofactor such as NADH. It is to be understood that iminosuccinate reductases are not limited to polypeptide variants derived from the naturally occurring iminosuccinate reductases from various bacteria, such as *Paracoccus denitrificans*, but may include other enzymes having iminosuccinate reductase activity, or recombinant variants of the naturally occurring iminosuccinate reductases, including but not limiting enzymes comprising the conserved amino acid sequence of $GX_aKX_aG(X_a)_8GX_aKX_aGG(X_a)_2PX_aN(X_a)_7$ $NHQS(X_a)_3LF(X_a)_4G(X_a)_8N(X_a)_2TAX_aRTAA(X_a)_4S(X_a)_3$ $L(X_a)_8G(X_a)_2GAGX_aQ(X_a)_3Q(X_a)_{15}WN(X_a)_{39}S(X_a)_{15}H$ $(X_a)_3MGTDT(X_a)_2KX_aE(X_a)_{13}D(X_a)_3Q(X_a)_4GEX_a$ $Q(X_a)_{16}G(X_a)_9R(X_a)_6T(X_a)_2DGX_aG(X_a)_3QDX_aA$ (SEQ ID NO: 663), wherein $X_a$ represents independently for each occurrence an amino acid as well as enzymes from proteobacteria (SEQ ID NO: 2 and 66-363), such as *Paracoccus denitrificans* (SEQ ID NO: 2).

As used herein, "erythro-β-hydroxyaspartate aldolase" (or synonymously L-erythro-3-hydroxyaspartate aldolase) refers to a polypeptide having a β-hydroxyaspartate aldolase activity, i.e. a polypeptide that catalyzes the reaction of glyoxylate and glycine to erythro-β-hydroxyaspartate. The β-hydroxyaspartate aldolase belongs to the EC class 4.1.3.14 (see Table 2). This enzyme is closely related to D-threonine aldolases and differs in the active site by three amino acids A160, A195 and S313, which may provide a signature sequence for this enzyme family (see Example 6).

As used herein, "erythro-β-hydroxyaspartate dehydratase" (or synonymously erythro-3-hydroxy-L-aspartate ammonia-lyase) refers to a polypeptide having a β-hydroxyaspartate dehydratase activity, i.e. a polypeptide that catalyzes the reaction of erythro-β-hydroxyaspartate to iminosuccinate. The β-hydroxyaspartate dehydratase belongs to the EC class 4.3.1.20 or former EC class 4.2.1.38 (see Table 2).

As used herein, "phosphoglycolate phosphatase" refers to a polypeptide having a phosphoglycolate phosphatase activity, i.e. a polypeptide that catalyzes the reaction of 2-phosphoglycolate and water to glycolate and phosphate. The phosphoglycolate phosphatase belongs to the EC class 3.1.3.18 (see Table 2).

As used herein, "glyoxylate reductase" refers to a polypeptide having a glyoxylate reductase activity, i.e. a polypeptide that catalyzes the oxidation of glycolate to glyoxylate in the presence of a cofactor, such as NAD phosphate. The phosphoglycolate phosphatase belongs to the EC class 1.1.1.26 (see Table 2).

"aspartate-glyoxylate transaminase" as used herein refers to a polypeptide having an aspartate-glyoxylate transaminase activity, i.e. an aspartate-glyoxylate transaminase catalyzes the reaction of aspartate and glyoxylate to oxaloacetate and glycine. It is to be understood that aspartate-glyoxylate transaminases are not limited to polypeptide variants derived from the naturally occurring aspartate-glyoxylate transaminases from various bacteria, such as *Paracoccus denitrificans*, but may include other enzymes having aspartate-glyoxylate transaminase activity, or recombinant variants of the naturally occurring aspartate-glyoxylate transaminases, including but not limiting enzymes comprising the conserved amino acid sequence of $W(X_b)_{12}L(X_b)_2$ $D(X_b)_{12}NETX_bTGVX_bS(X_b)_{20}DX_bVSS(X_b)_5F(X_b)_4$ $W(X_b)_2D(X_b)_4GSQKGX_bM(X_b)_3G(X_b)_{38}PX_bTP(X_b)_6G$ $(X_b)_{11}E(X_b)_7RH(X_b)_3A(X_b)_3R(X_b)_5W(X_b)_5A(X_b)_6S(X_b)_8P$ $(X_b)_{20}GX_bG(X_b)_8FRX_bGHX_bG(X_b)_{14}E(X_b)_{12}GX_bG(X_b)_2$ AA (SEQ ID NO: 664), wherein $X_b$ represents independently for each occurrence an amino acid; enzymes comprising the conserved amino acid sequence of $X^4X^7X_cX^6X_cX^9X^4X_cX_cX_cX^4X_cX_cX_cWX^9X_cX^7X^4X^7X_c$- $X_cX_cX^4X^9X^9X_cLX_cX_cDX_cX_cX_cX^4X^5X^5X^2X^4X^7X^7X^5$- $NETX^8TGVX_cSX^5X^2X^9X_cX^4X^9X^9X_cX^4X_cX_cX_cX_cX^5X_c$- $X^8X^4X^4X^4X^2DX^7VSSX^2X^8X^7X^4X_cFX^9X_cX^9X^9WX_cX^2$- $DX^4X^7X^2X^7GSQKGX^4MX^4X_cX^7GX^4X^7X^4X^4X^7X^4X^8$- $X_cX^4X^8X_cX_cX_cX_cX_cX^7X_cX^4X_cX^5X^4X^3X^4X^9X^4X^9X^9$- $X_cX_cX_cX_cX_cX_cX_cX^4PX_cTPX_AX^9X^4X^4X_cGX^4X_c$- $X_cX^7X_cX^9X_cX^4X_cX_cX^9EX^9X^4X_cX^9X^2X^4X^9RHX_cX^4X^4$- $AX^9X^8X^4RX_cX^8X^4X_cX^8WX^9X^4X_cX_cX^4AX_cX^9X_cX^9X_c$- $X_cSX_cX^1X^2X^1X^7X^2X_cX^4PX_cX^9X^4X^5X^8X_cX_cX^4X^4X^9X_c$- $X^7X_cX_cX^3X^9X^4X^8X^4GX_cGX_4X_cX_cX^4X_cX^7X^5X^4FRX^2$- $GHX^2GX_cX^4X^7X_cX_cX_cX^4X_cX_cX^8X^2X^7X_cX^4EX^4X^7$- $X^{44}X^9X_cX^9X^4X_cX^4X_cX_cGX_cGX^7X_cAAX_cX^9X_cX^4$ (SEQ ID NO: 665), wherein $X_c$ represents independently for each occurrence an amino acid, $X^1$ represents independently for each occurrence S or T; $X^2$ represents independently for each occurrence I, L or V; $X^3$ represents independently for each occurrence F, H, W or Y; $X^4$ represents independently for each occurrence A, C, F, G, H, I, K, L, M, R, T, V, W or Y; $X^5$ represents independently for each occurrence C, D, E, H, K, N, Q, R, S or T; $X^6$ represents independently for each occurrence H, K or R; $X^7$ represents independently for each occurrence A, C, D, G, N, P, S, T or V; $X^8$ represents independently for each occurrence A, G or S, and $X^9$ represents independently for each occurrence A, C, D, E, G, H, K, N, Q, R, S or T, as well as enzymes from proteobacteria (SEQ ID NO: 8 and 364-662), such as Paracoccus denitrificans (SEQ ID NO: 8).

Thus, within this conserved amino acid sequences disclosed herein, each $X_a$, $X_b$, $X_c$ and $X_d$ represents independently of each other and independently for each occurrence within the same conserved amino acid sequence exactly one amino acid and preferably one proteinogenic amino acid and more preferably exactly one canonic amino acid.

"Percentage of sequence identity" and "percentage homology" are used interchangeably herein to refer to comparisons among nucleic acids and polypeptides, and are determined by comparing two optimally aligned sequences over a comparison window, wherein the portion of the nucleic acids or polypeptide sequence in the comparison window may comprise additions or deletions (i.e. gaps) as compared to the reference sequence for optimal alignment of the two sequences. The percentage may be calculated by determining the number of positions at which the identical nucleic acid base or amino acid residue occurs in both sequences to yield the number of matched positions, dividing the number of matched positions by the total number of positions in the window of comparison and multiplying the result by 100 to yield the percentage of sequence identity. Alternatively, the percentage may be calculated by determining the number of positions at which either the identical nucleic acid base or amino acid residue occurs in both sequences or a nucleic acid base or amino acid residue is aligned with a gap to yield the number of matched positions, dividing the number of matched positions by the total number of positions in the window of comparison and multiplying the result by 100 to yield the percentage of sequence identity. Those of skill in the art appreciate that there are many established algorithms available to align two sequences.

"Reference sequence" refers to a defined sequence used as a basis for a sequence comparison. A reference sequence may be a subset of a larger sequence, for example, a segment of a full-length gene or polypeptide sequence. Generally, a reference sequence is at least 20 nucleotide or amino acid residues in length, at least 25 residues in length, at least 50 residues in length, or the full length of the nucleic acid or polypeptide. Since two nucleic acids or polypeptides may each (1) comprise a sequence (i.e., a portion of the complete sequence) that is similar between the two sequences, and (2) may further comprise a sequence that is divergent between the two sequences, sequence comparisons between two (or more) nucleic acids or polypeptide are typically performed by comparing sequences of the two nucleic acids or polypeptides over a "comparison window" to identify and compare local regions of sequence similarity. In some embodiments, a "reference sequence" can be based on a primary amino acid sequence, where the reference sequence is a sequence that can have one or more changes in the primary sequence.

"Substantial identity" refers to a nucleic acid or polypeptide sequence that has at least 80 percent sequence identity, at least 85 percent identity and 89 to 95 percent sequence identity, more usually at least 99 percent sequence identity as compared to a reference sequence over a comparison window of at least 20 residue positions, frequently over a window of at least 30-50 residues, wherein the percentage of sequence identity is calculated by comparing the reference sequence to a sequence that includes deletions or additions which total 20 percent or less of the reference sequence over the window of comparison. In specific embodiments applied to polypeptides, the term "substantial identity" means that two polypeptide sequences, when optimally aligned, share at least 80 percent sequence identity, preferably at least 89 percent sequence identity, at least 95 percent sequence identity or more (e.g., 99 percent sequence identity). Preferably, residue positions which are not identical differ by conservative amino acid substitutions.

"Deletion" refers to modification to the polypeptide by removal of one or more amino acids from the reference polypeptide. Deletions can comprise removal of 1 or more amino acids, 2 or more amino acids, 5 or more amino acids, 10 or more amino acids, or more amino acids, or 20 or more amino acids, up to 10% of the total number of amino acids, or up to 20% of the total number of amino acids making up the reference enzyme while retaining enzymatic activity and/or retaining the improved properties of an engineered imine reductase enzyme. Deletions can be directed to the internal portions and/or terminal portions of the polypeptide. In various embodiments, the deletion can comprise a continuous segment or can be discontinuous.

"Insertion" refers to modification to the polypeptide by addition of one or more amino acids from the reference polypeptide. In some embodiments, the improved engineered imine reductase enzymes comprise insertions of one or more amino acids to the naturally occurring polypeptide having imine reductase activity as well as insertions of one or more amino acids to other improved imine reductase polypeptides. Insertions can be in the internal portions of the polypeptide, or to the carboxy or amino terminus. Insertions as used herein include fusion proteins as is known in the art. The insertion can be a contiguous segment of amino acids or separated by one or more of the amino acids in the naturally occurring polypeptide.

"Cofactor regeneration system" or "cofactor recycling system" refers to a set of reactants that participate in a reaction that reduces the oxidized form of the cofactor (e.g., $NADP^+$ to NADPH). Cofactors oxidized by the imine reductase catalyzed reductive amination of a ketone substrate are regenerated in reduced form by the cofactor regeneration system. Cofactor regeneration systems comprise a stoichiometric reductant that is a source of reducing hydrogen equivalents and is capable of reducing the oxidized form of the cofactor. The cofactor regeneration system may further comprise a catalyst, for example an enzyme catalyst that catalyzes the reduction of the oxidized form of the cofactor by the reductant. Cofactor regeneration systems to regenerate NADH from $NAD^+$ or NADPH from $NADP^+$, respectively, are known in the art and may be used in the methods described herein.

"Formate dehydrogenase" and "FDH" are used interchangeably herein to refer to an $NAD^+$ or $NADP^+$-dependent enzyme that catalyzes the conversion of formate and $NAD^+$ or $NADP^+$ to carbon dioxide and NADH or NADPH, respectively.

"Heterologous" as used herein means "of different natural or of synthetic origin" or represent a nonnatural state. For example, if a host cell or microorganism is transformed with a nucleic sequence derived from another organism, particularly from another microorganism, that gene is heterologous with respect to that host cell or microorganism and also with respect to descendants of the host cell which carry that gene. The transforming nucleic acid may comprise a heterologous promoter, heterologous coding sequence, or heterologous termination sequence. Alternatively, the transforming nucleic acid may be completely heterologous or may comprise any possible combination of heterologous and endogenous nucleic acid sequences.

The term "promoter" refers to a DNA sequence that initiates transcription of an associated DNA sequence. The promoter region may also include elements that act as regulators of gene expression such as activators, enhancers, and/or repressors.

"Synthetic nucleotide sequence" as used herein means a nucleotide sequence comprising structural characters that are not present in the natural sequence. For example, an artificial sequence that resembles more closely the G+C content and the normal codon distribution of dicot and/or monocot genes is said to be synthetic. A regulatory DNA sequence is said to be "operably linked to" or "associated with" a DNA sequence that codes for an RNA or a protein if the two sequences are situated such that the regulatory DNA sequence affects expression of the coding DNA sequence.

"Microorganism" (or microbe) refers to a microscopic organism, which may exist in its single-celled form or in a colony of cells and which is not visible to the naked eye as individual. Microorganisms include all unicellular organisms, including prokaryotes (prokaryotic microorganisms), such as bacteria (e.g. cyanobacteria, proteobacteria, purple bacteria and green sulfur bacteria) and archaea (e.g. halophiles and methanogens), and unicellular eukaryotes (eukaryotic microorganisms, e.g. microalgae), such as protists and protozoans. Protists which are related to animals and some to green plants are not microorganisms as described herein. Although many of the multicellular organisms are microscopic, namely micro-animals, some fungi and some algae, these organisms do not belong to microorganisms as used herein.

"Autotrophic microorganism", as used herein, refers to a microorganism that produces complex organic compounds (such as carbohydrates, fats, and proteins) from simple substances present in its surroundings, such as carbon dioxide and water, generally using energy from light (photosynthesis, photoautotroph) or inorganic chemical reactions (chemosynthesis, chemoautotroph). In contrast, microorganisms that rely on organic compounds as a source of carbon, but are able to use light or inorganic compounds as a source of energy are referred to as heterotrophic microorganisms. Such microorganisms are not defined as autotrophic, but rather as heterotrophic.

The present invention is directed to a method for the production of autotrophic microorganisms with altered photorespiration and improved $CO_2$ fixation comprising introducing into the autotrophic microorganism one or more nucleic acids encoding polypeptides having the enzymatic activities of (i) phosphoglycolate phosphatase,
(ii) glyoxylate reductase,
(iii) erythro-β-hydroxyaspartate aldolase belonging to the EC class 4.1.3.14,
(iv) erythro-β-hydroxyaspartate dehydratase belonging to the EC class 4.3.1.20,
(v) iminosuccinate reductase and
(vi) aspartate-glyoxylate transaminase, wherein the introduction of the nucleic acid(s) results in a de novo expression of polypeptides having the enzymatic activities of (i) phosphoglycolate phosphatase,
(ii) glyoxylate reductase,
(iii) erythro-β-hydroxyaspartate aldolase belonging to the EC class 4.1.3.14,
(iv) erythro-β-hydroxyaspartate dehydratase belonging to the EC class 4.3.1.20,
(v) iminosuccinate reductase and
(vi) aspartate-glyoxylate transaminase, wherein the polypeptide having the enzymatic activity of (v) iminosuccinate reductase comprises the conserved amino acid sequence of comprising the conserved amino acid sequence of $GX_aKX_aG(X_a)_8GX_aKX_aGG(X_a)_2PX_a$-$N(X_a)_7NHQS(X_a)_3LF(X_a)_4G(X_a)_8N(X_a)_2TAX_aRTAA$-$(X_a)_4S(X_a)_3L(X_a)_8G(X_a)_2GAGX_aQ(X_a)_3Q(X_a)_{15}WN$-$(X_a)_{39}S(X_a)_{15}H(X_a)_3MGTDT(X_a)_2KX_aE(X_a)_{13}D(X_a)_3Q$ $(X_a)_4GEX_aQ(X_a)_{16}G(X_a)_9R(X_a)_6T(X_a)_2DGX_aG(X_a)_3$ $QDX_aA$ (SEQ ID NO: 663), wherein $X_a$ represents independently for each occurrence an amino acid;

and the polypeptide having the enzymatic activity of (vi) aspartate-glyoxylate transaminase comprises the conserved amino acid sequence of $W(X_b)_{12}L(X_b)_2D(X_b)_{12}$ $NETX_bTGVX_bS(X_b)_{20}DX_bVSS(X_b)_5F(X_b)_4W(X_b)_2D(X_b)_4$ $GSQKGX_bM(X_b)_3G(X_b)_{38}PX_bTP(X_b)_6G(X_b)_{11}E(X_b)_7RH$ $(X_b)_3A(X_b)_3R(X_b)_5W(X_b)_5A(X_b)_6S(X_b)_8P(X_b)_{20}GX_bG$ $(X_b)_8FRX_bGHX_bG(X_b)_{14}E(X_b)_{12}GX_bG(X_b)_2AA$ (SEQ ID NO: 664), wherein $X_b$ represents independently for each occurrence an amino acid.

The conserved amino acid sequence of SEQ ID NO: 663 consists of 251 amino acids, wherein each $X_a$ represents independently of each other exactly one amino acid and preferably one proteinogenic amino acids and more preferably exactly one canonic amino acid.

The conserved amino acid sequence of SEQ ID NO: 664 consists of 270 amino acids, wherein each $X_b$ represents independently of each other exactly one amino acid and preferably one proteinogenic amino acids and more preferably exactly one canonic amino acid.

The method of the present invention bypasses the natural photorespiration pathway in autotrophic microorganisms with the β-hydroxyaspartate pathway. For this, several enzymes have to be expressed in the autotrophic microorganism that convert the substrate of the natural photorespiration pathway 2-phosphoglycolate to the substrate of BHAP glyoxylate and that are not part of the BHAP cycle. Such enzymes are for instance, but not limited to, (i) phosphoglycolate phosphatase and (ii) glyoxylate reductase. The phosphoglycolate phosphatase hydrolyzes 2-phosphoglycolate to glycolate and the glyoxylate reductase oxidizes glycolate to glyoxylate, as shown in FIG. 6. The phosphoglycolate phosphatase and the glyoxylate reductase may be derived from any microorganism. Preferably, the glyoxylate reductase is derived from *Arabidopsis thaliana*.

The BHAP is widely distributed among proteobacteria, particularly alpha- and gamma-proteobacteria, such as *Aestuariivita boseongensis, Agrobacterium* sp., *Ahrensia* sp., *Aminobacter aminovorans, Amphritea atlantica, Antarctobacter heliothermus, Aquisalimonas asiatica, Aurantimonas altamirensis, Aureimonas altamirensis, Brevirhabdus pacifica, Citreicella marina, Citreicella* sp., *Citreicella thiooxidans, Citreimonas salinaria, Colwellia piezophila, Colwellia psychrerythraea, Colwellia sp, Cribrihabitans marinus, Defluviimonas indica, Defluviimonas* sp., *Dinoroseobacter shibae, Ensifer fredii, Ensifer meliloti, Ensifer* sp., *Glaciecola* sp., *Granulosicoccus antarcticus, Halocynthiibacter* sp., *Hasllibacter halocynthiae, Hyphomicrobium sulfonivorans, Jannaschia pohangensis, Jannaschia rubra, Jannaschia* sp., *Labrenzia aggregata, Labrenzia alba, Labrenzia alexandrii, Labrenzia* sp., *Leisingera aquaemixtae, Leisingera nanhaiensis, Leisingera* sp., *Litoreibacter ascidiaceicola, Litoreibacter halocynthiae, Litoreibacter janthinus, Litoreibacter meonggei, Litoreibacter ponti, Loktanella koreensis, Loktanella Noma, Loktanella maricola, Loktanella rosea, Loktanella sediminilitoris, Loktanella sediminum, Loktanella* sp., *Loktanella vestfoldensis, Mameliella alba, Maribius* sp., *Marinobacter psychrophilus, Marinobacter* sp., *Marinobacterium lutimaris, Marinobacterium mangrovicola, Marinobacterium* sp., *Marinomonas* sp., *Marinovum algicola, Maritimibacter* sp., *Marivita geojedonensis, Marivita hallyeonensis, Mesorhizobium* sp., *Mesorhizobium* sp., *Methylobacterium komagatae, Methylobacterium mesophilicum, Methylobacterium radiotolerans, Methylobacterium* sp., *Methylobacterium* sp., *Methylopila* sp., *Neptunomonas antarctica, Nitratireductor* sp., *Oceanicola flagellatus, Oceanicola nitratireducens, Oceanicola* sp., *Oceaniovalibus guishaninsula, Octadecabacter antarcticus, Octadecabacter arcticus, Octadecabacter temperatus, Palleronia marismioris*, pAqui_F126, *Paracoccus alcaliphilus, Paracoccus alkenifer, Paracoccus aminophilus, Paracoccus aminovorans, Paracoccus denitrificans, Paracoccus halophilus, Paracoccus homiensis, Paracoccus isoporae, Paracoccus pantotrophus, Paracoccus saliphilus, Paracoccus sediminis, Paracoccus* sp., *Paracoccus thiocyanatus, Paracoccus versutus, Paracoccus yeei, Pararhodobacter aggregans*, pCaer_C109, pDaep_A276, *Pelagibaca bermudensis, Pelagicola litoralis, Pelagimonas varians, Phaeobacter gallaeciensis, Phaeobacter inhibens, Planktotalea frisia*, pMeth_A285, *Ponticoccus litoralis, Ponticoccus* sp., *Poseidonocella pacifica, Pseudomonas stutzeri, Pseudopelagicola gijangensis, Pseudorhodobacter antarcticus, Pseudoruegeria haliotis, Pseudoruegeria marinistellae, Psychrobacter arcticus, Psychrobacter cryohalolentis, Psychrobacter* sp., *Psychrobacter urativorans, Puniceibacterium sediminis, Rhizobium etli, Rhizobium etli, Rhizobium etli, Rhizobium leguminosarum, Rhizobium lusitanum, Rhizobium rhizogenes, Rhizobium* sp., *Rhizobium taibaishanense, Rhizobium tropici, Rhizobium yanglingense, Rhodobaca barguzinensis, Rhodobacteraceae bacterium, Rhodobacteraceae* sp., *Rhodobacterales bacterium, Rhodovibrio salinarum, Rhodovulum kholense, Rhodovulum* sp., *Rhodovulum sulfidophilum, Roseinatronobacter thiooxidans, Roseivivax halodurans, Roseivivax isoporae, Roseivivax lentus, Roseivivax sediminis, Roseobacter denitrificans, Roseobacter litoralis, Roseobacter* sp., *Roseovarius azorensis, Roseovarius indicus, Roseovarius litoreus, Roseovarius lutimaris, Roseovarius marisflavi, Roseovarius mucosus, Roseovarius nubinhibens, Roseovarius sediminilitoris, Roseovarius* sp., *Roseovarius tolerans, Rubellimicrobium mesophilum, Rubrimonas cliftonensis, Ruegeria atlantica, Ruegeria conchae, Ruegeria faecimaris, Ruegeria halocynthiae, Ruegeria marina, Ruegeria mobilis, Ruegeria scottomollicae, Ruegeria* sp., *Sagittula stellata, Salinihabitans flavidus, Shimia haliotis, Shimia sagamensis, Silicibacter* sp., *Sinorhizobium americanum, Sinorhizobium fredii,*

*Sinorhizobium terangae, Solemya velum, Sphingomonas* sp., *Stappia aggregata, Starkeya novella, Sulfitobacter pseudonitzschiae, Sulfitobacter* sp., *Tateyamaria omphalii, Tateyamaria* sp., *Thalassobacter* sp., *Thalassobacter stenotrophicus, Thalassobius abyssi, Thalassobius aestuarii, Thalassobius mediterraneus, Thalassotalea* sp., uncultured *Rhodobacteriaceae, Yangia pacifica, Yangia pacifica, Yangia* sp., *Para coccus sulfuroxidans*, AP *Rhodobacteraceae bacterium* and *Silicibacter pomeroyi*.

Therefore, the present invention is also directed to a method for the production of autotrophic microorganisms with altered photorespiration and improved $CO_2$ fixation comprising introducing into the autotrophic microorganism one or more nucleic acids encoding polypeptides having the enzymatic activities of
  (i) phosphoglycolate phosphatase,
  (ii) glyoxylate reductase,
  (iii) erythro-β-hydroxyaspartate aldolase belonging to the EC class 4.1.3.14,
  (iv) erythro-β-hydroxyaspartate dehydratase belonging to the EC class 4.3.1.20,
  (v) iminosuccinate reductase and
  (vi) aspartate-glyoxylate transaminase,
wherein the introduction of the nucleic acid(s) results in a de novo expression of polypeptides having the enzymatic activities of
  (i) phosphoglycolate phosphatase,
  (ii) glyoxylate reductase,
  (iii) erythro-β-hydroxyaspartate aldolase belonging to the EC class 4.1.3.14,
  (iv) erythro-β-hydroxyaspartate dehydratase belonging to the EC class 4.3.1.20,
  (v) iminosuccinate reductase and
  (vi) aspartate-glyoxylate transaminase,
wherein the polypeptide having the enzymatic activity of (v) iminosuccinate reductase comprises the conserved amino acid sequence of comprising the conserved amino acid sequence of $GX_aKX_aG(X_a)_8GX_aKX_aGG(X_a)_2PX_a$-$N(X_a)_7NHQS(X_a)_3LF(X_a)_4G(X_a)_8N(X_a)_2TAX_aRTAA$-$(X_a)_4S(X_a)_3L(X_a)_8G(X_a)_2GAGX_aQ(X_a)_3Q(X_a)_{15}WN$-$(X_a)_{39}S(X_a)_{15}H(X_a)_3MGTDT(X_a)_2KX_aE(X_a)_{13}D(X_a)_3Q$ $(X_a)_4GEX_aQ(X_a)_{16}G(X_a)_9R(X_a)_6T(X_a)_2DGX_aG(X_a)_3$ $QDX_aA$ (SEQ ID NO: 663), wherein $X_a$ represents independently for each occurrence an amino acid;
and the polypeptide having the enzymatic activity of (vi) aspartate-glyoxylate transaminase comprises the conserved amino acid sequence of $W(X_b)_{12}L(X_b)_2D(X_b)_{12}$ $NETX_bTGVX_bS(X_b)_{20}DX_bVSS(X_b)_5F(X_b)_4W(X_b)_2D(X_b)_4$ $GSQKGX_bM(X_b)_3G(X_b)_{38}PX_bTP(X_b)_6G(X_b)_{11}E(X_b)_7RH$ $(X_b)_3A(X_b)_3R(X_b)_5W(X_b)_5A(X_b)_6S(X_b)_8P(X_b)_{20}GX_bG$ $(X_b)_8FRX_bGHX_bG(X_b)_{14}E(X_b)_{12}GX_bG(X_b)_2AA$ (SEQ ID NO: 664), wherein $X_b$ represents independently for each occurrence an amino acid; and
wherein the de novo expressed polypeptides having the enzymatic activities (iii) erythro-β-hydroxyaspartate aldolase, (iv) erythro-β-hydroxyaspartate dehydratase, (v) iminosuccinate reductase and (vi) aspartate-glyoxylate transaminase are preferably derived from proteobacteria.

Moreover, in the inventive methods described herein, the de novo expressed polypeptides having the enzymatic activities (iii) erythro-β-hydroxyaspartate aldolase, (iv) erythro-β-hydroxyaspartate dehydratase, (v) iminosuccinate reductase and (vi) aspartate-glyoxylate transaminase are preferably derived from alpha- or gamma-proteobacteria. Also, in the inventive methods described herein, the de novo expressed polypeptides having the enzymatic activities (iii) erythro-β-hydroxyaspartate aldolase, (iv) erythro-β-hydroxyaspartate dehydratase, (v) iminosuccinate reductase and (vi) aspartate-glyoxylate transaminase are preferably derived from proteobacteria which belong to the genus selected from *Aquisalimonas, Poseidonocella, Marinobacter, Litoreibacter, Thalassobacter, Ruegeria, Paracoccus, Roseobacter, Leisingera, Loktanella, Methylobacterium, Sinorhizobium, Rhizobium, Agrobacter, Cribrihabitans, Dinoroseobacter, Octadecabacter, Planktotalea, Psychrobacter, Yangia, Pseudorhodobacter* or *Neptunomonas*. In one embodiment of the inventive method, the de novo expressed polypeptides having the enzymatic activities (iii) erythro-β-hydroxyaspartate aldolase, (iv) erythro-β-hydroxyaspartate dehydratase, (v) iminosuccinate reductase and (vi) aspartate-glyoxylate transaminase are preferably derived from *Paracoccus denitrificans*.

Preferably, the nucleic acids encoding the polypeptides having the enzymatic activities of (i) phosphoglycolate phosphatase, (ii) glyoxylate reductase, (iii) erythro-β-hydroxyaspartate aldolase, (iv) erythro-β-hydroxyaspartate dehydratase, (v) iminosuccinate reductase and (vi) aspartate-glyoxylate transaminase comprise a polynucleotide sequence of at least 60% sequence identity to SEQ ID NOs: 1, 3, 5, 7, 62 and 64 or SEQ ID NOs: 43-46, 62 and 64. Thus, in one embodiment, the method for the production of autotrophic microorganisms with altered photorespiration and improved $CO_2$ fixation comprises introducing into the autotrophic microorganism one or more nucleic acids encoding polypeptides having the enzymatic activities of
  (i) phosphoglycolate phosphatase,
  (ii) glyoxylate reductase,
  (iii) erythro-β-hydroxyaspartate aldolase belonging to the EC class 4.1.3.14,
  (iv) erythro-β-hydroxyaspartate dehydratase belonging to the EC class 4.3.1.20,
  (v) iminosuccinate reductase and
  (vi) aspartate-glyoxylate transaminase,
wherein the introduction of the nucleic acid(s) results in a de novo expression of polypeptides having the enzymatic activities of
  (i) phosphoglycolate phosphatase,
  (ii) glyoxylate reductase,
  (iii) erythro-β-hydroxyaspartate aldolase belonging to the EC class 4.1.3.14,
  (iv) erythro-β-hydroxyaspartate dehydratase belonging to the EC class 4.3.1.20,
  (v) iminosuccinate reductase and
  (vi) aspartate-glyoxylate transaminase,
wherein the polypeptide having the enzymatic activity of (v) iminosuccinate reductase comprises the conserved amino acid sequence of comprising the conserved amino acid sequence of $GX_aKX_aG(X_a)_8GX_aKX_aGG(X_a)_2PX_a$-$N(X_a)_7NHQS(X_a)_3LF(X_a)_4G(X_a)_8N(X_a)_2TAX_aRTAA$ $(X_a)_4S(X_a)_3L(X_a)_8G(X_a)_2GAGX_aQ(X_a)_3Q(X_a)_{15}WN$-$(X_a)_{39}S(X_a)_{15}H(X_a)_3MGTDT(X_a)_2KX_aE(X_a)_{13}D(X_a)_3Q$ $(X_a)_4GEX_aQ(X_a)_{16}G(X_a)_9R(X_a)_6T(X_a)_2DGX_aG(X_a)_3$ $QDX_aA$ (SEQ ID NO: 663), wherein $X_a$ represents independently for each occurrence an amino acid;
and the polypeptide having the enzymatic activity of (vi) aspartate-glyoxylate transaminase comprises the conserved amino acid sequence of $W(X_b)_{12}L(X_b)_2D(X_b)_{12}$ $NETX_bTGVX_bS(X_b)_{20}DX_bVSS(X_b)_5F(X_b)_4W(X_b)_2D(X_b)_4$ $GSQKGX_bM(X_b)_3G(X_b)_{38}PX_bTP(X_b)_6G(X_b)_{11}E(X_b)_7RH$ $(X_b)_3A(X_b)_3R(X_b)_5W(X_b)_5A(X_b)_6S(X_b)_8P(X_b)_{20}GX_bG$ $(X_b)_8FRX_bGHX_bG(X_b)_{14}E(X_b)_{12}GX_bG(X_b)_2AA$ (SEQ ID NO: 664), wherein $X_b$ represents independently for each occurrence an amino acid; and wherein the nucleic acids encoding the polypeptides having the enzymatic activities of (i) phosphoglycolate phosphatase, (ii) glyoxylate reductase, (iii) erythro-β-hydroxyaspartate aldolase, (iv) erythro-β-hydroxyaspartate dehydratase, (v) iminosuccinate reductase and (vi) aspartate-glyoxylate transaminase comprise a polynucleotide sequence of preferably at least 60% sequence identity to SEQ ID NOs: 1, 3, 5, 7, 62 and 64 or SEQ ID NOs: 43-46, 62 and 64, more preferably at least 80% sequence identity to SEQ ID NOs: 1, 3, 5, 7, 62 and 64 or SEQ ID NOs: 43-46, 62 and 64, even more preferably at least 90% sequence identity to SEQ ID NOs: 1, 3, 5, 7, 62 and 64 or SEQ ID NOs: 43-46, 62 and 64, more preferably at least 95% sequence identity to SEQ ID NOs: 1, 3, 5, 7, 62 and 64 or SEQ ID NOs: 43-46, 62 and 64, more preferably at least 97% sequence identity to SEQ ID NOs: 1, 3, 5, 7, 62 and 64 or SEQ ID NOs: 43-46, 62 and 64, more preferably at least 98% sequence identity to SEQ ID NOs: 1, 3, 5, 7, 62 and 64 or SEQ ID NOs: 43-46, 62 and 64, more preferably at least 99% sequence identity to SEQ ID NOs: 1, 3, 5, 7, 62 and 64 or SEQ ID NOs: 43-46, 62 and 64 and most preferably 100% sequence identity to SEQ ID NOs: 1, 3, 5, 7, 62 and 64 or SEQ ID NOs: 43-46, 62 and 64.

Preferably, the nucleic acids encoding the polypeptides having the enzymatic activities of (i) phosphoglycolate phosphatase, (ii) glyoxylate reductase, (iii) erythro-β-hydroxyaspartate aldolase, (iv) erythro-β-hydroxyaspartate dehydratase, (v) iminosuccinate reductase and (vi) aspartate-glyoxylate transaminase comprise a polynucleotide sequence of at least 80% sequence identity to SEQ ID NOs: 1, 3, 5, 7, 62 and 64 or SEQ ID NOs: 43-46, 62 and 64. Thus, in one embodiment, the method for the production of autotrophic microorganisms with altered photorespiration and improved $CO_2$ fixation comprises introducing into the autotrophic microorganism one or more nucleic acids encoding polypeptides having the enzymatic activities of
 (i) phosphoglycolate phosphatase,
 (ii) glyoxylate reductase,
 (iii) erythro-β-hydroxyaspartate aldolase belonging to the EC class 4.1.3.14,
 (iv) erythro-β-hydroxyaspartate dehydratase belonging to the EC class 4.3.1.20,
 (v) iminosuccinate reductase and
 (vi) aspartate-glyoxylate transaminase,
wherein the introduction of the nucleic acid(s) results in a de novo expression of polypeptides having the enzymatic activities of
 (i) phosphoglycolate phosphatase,
 (ii) glyoxylate reductase,
 (iii) erythro-β-hydroxyaspartate aldolase belonging to the EC class 4.1.3.14,
 (iv) erythro-β-hydroxyaspartate dehydratase belonging to the EC class 4.3.1.20,
 (v) iminosuccinate reductase and
 (vi) aspartate-glyoxylate transaminase,
wherein the polypeptide having the enzymatic activity of (v) iminosuccinate reductase comprises the conserved amino acid sequence of comprising the conserved amino acid sequence of $GX_aKX_aG(X_a)_8GX_aKX_aGG(X_a)_2PX_a$-$N(X_a)_7NHQS(X_a)_3LF(X_a)_4G(X_a)_8N(X_a)_2TAX_aRTAA$-$(X_a)_4S(X_a)_3L(X_a)_8G(X_a)_2GAGX_aQ(X_a)_3Q(X_a)_{15}WN$-$(X_a)_{39}S(X_a)_{15}H(X_a)_3MGTDT(X_a)_2KX_aE(X_a)_{13}D(X_a)_3Q$ $(X_a)_4GEX_aQ(X_a)_{16}G(X_a)_9R(X_a)_6T(X_a)_2DGX_aG(X_a)_3$ $QDX_aA$ (SEQ ID NO: 663), wherein $X_a$ represents independently for each occurrence an amino acid;
and the polypeptide having the enzymatic activity of (vi) aspartate-glyoxylate transaminase comprises the conserved amino acid sequence of $W(X_b)_{12}L(X_b)_2D(X_b)_{12}$ $NETX_bTGVX_bS(X_b)_{20}DX_bVSS(X_b)_5F(X_b)_4W(X_b)_2D(X_b)_4$ $GSQKGX_bM(X_b)_3G(X_b)_{38}PX_bTP(X_b)_6G(X_b)_{11}E(X_b)_7RH$ $(X_b)_3A(X_b)_3R(X_b)_5W(X_b)_5A(X_b)_6S(X_b)_8P(X_b)_{20}GX_bG$ $(X_b)_8FRX_bGHX_bG(X_b)_{14}E(X_b)_{12}GX_bG(X_b)_2AA$ (SEQ ID NO: 664), wherein $X_b$ represents independently for each occurrence an amino acid; and
wherein the nucleic acids encoding the polypeptides having the enzymatic activities of (i) phosphoglycolate phosphatase, (ii) glyoxylate reductase, (iii) erythro-β-hydroxyaspartate aldolase, (iv) erythro-β-hydroxyaspartate dehydratase, (v) iminosuccinate reductase and (vi) aspartate-glyoxylate transaminase comprise a polynucleotide sequence of at least 80% sequence identity to SEQ ID NOs: 1, 3, 5, 7, 62 and 64 or SEQ ID NOs: 43-46, 62 and 64.

In one embodiment, the method for the production of autotrophic microorganisms with altered photorespiration and improved $CO_2$ fixation comprises introducing into the autotrophic microorganism one or more nucleic acids encoding polypeptides having the enzymatic activities of
 (i) phosphoglycolate phosphatase,
 (ii) glyoxylate reductase,
 (iii) erythro-β-hydroxyaspartate aldolase belonging to the EC class 4.1.3.14,
 (iv) erythro-β-hydroxyaspartate dehydratase belonging to the EC class 4.3.1.20,
 (v) iminosuccinate reductase and
 (vi) aspartate-glyoxylate transaminase,
wherein the introduction of the nucleic acid(s) results in a de novo expression of polypeptides having the enzymatic activities of
 (i) phosphoglycolate phosphatase,
 (ii) glyoxylate reductase,
 (iii) erythro-β-hydroxyaspartate aldolase belonging to the EC class 4.1.3.14,
 (iv) erythro-β-hydroxyaspartate dehydratase belonging to the EC class 4.3.1.20,
 (v) iminosuccinate reductase and
 (vi) aspartate-glyoxylate transaminase,
wherein the polypeptide having the enzymatic activity of (v) iminosuccinate reductase comprises the conserved amino acid sequence of comprising the conserved amino acid sequence of $GX_aKX_aG(X_a)_8GX_aKX_aGG(X_a)_2PX_a$-$N(X_a)_7NHQS(X_a)_3LF(X_a)_4G(X_a)_8N(X_a)_2TAX_aRTAA$ $(X_a)_4(X_a)_3L(X_a)_8G(X_a)_2GAGX_aQ(X_a)_3Q(X_a)_{15}WN$-$(X_a)_{39}S(X_a)_{15}H(X_a)_3MGTDT(X_a)_2KX_aE(X_a)_{13}D(X_a)_3Q$ $(X_a)_4GEX_aQ(X_a)_{16}G(X_a)_9R(X_a)_6T(X_a)_2DGX_aG(X_a)_3$ $QDX_aA$ (SEQ ID NO: 663), wherein $X_a$ represents independently for each occurrence an amino acid;
and the polypeptide having the enzymatic activity of (vi) aspartate-glyoxylate transaminase comprises the conserved amino acid sequence of $W(X_b)_{12}L(X_b)_2D(X_b)_{12}$ $NETX_bTGVX_bS(X_b)_{20}DX_bVSS(X_b)_5F(X_b)_4W(X_b)_2D(X_b)_4$ $GSQKGX_bM(X_b)_3G(X_b)_{38}PX_bTP(X_b)_6G(X_b)_{11}E(X_b)_7RH$ $(X_b)_3A(X_b)_3R(X_b)_5W(X_b)_5A(X_b)_6S(X_b)_8P(X_b)_{20}GX_bG$ $(X_b)_8FRX_bGHX_bG(X_b)_{14}E(X_b)_{12}GX_bG(X_b)_2AA$ (SEQ ID NO: 664), wherein $X_b$ represents independently for each occurrence an amino acid; and
wherein the nucleic acids encoding the polypeptides having the enzymatic activities of (i) phosphoglycolate phosphatase, (ii) glyoxylate reductase, (iii) erythro-β-hydroxyaspartate aldolase, (iv) erythro-β-hydroxyaspartate dehydratase, (v) iminosuccinate reductase and (vi) aspartate-glyoxylate transaminase comprise a polynucleotide sequence of at least 80% sequence identity to SEQ ID NOs: 1, 3, 5, 7, 62 and 64.

In another embodiment, the method for the production of autotrophic microorganisms with altered photorespiration and improved $CO_2$ fixation comprises introducing into the autotrophic microorganism one or more nucleic acids encoding polypeptides having the enzymatic activities of
(i) phosphoglycolate phosphatase,
(ii) glyoxylate reductase,
(iii) erythro-β-hydroxyaspartate aldolase belonging to the EC class 4.1.3.14,
(iv) erythro-β-hydroxyaspartate dehydratase belonging to the EC class 4.3.1.20,
(v) iminosuccinate reductase and
(vi) aspartate-glyoxylate transaminase,
wherein the introduction of the nucleic acid(s) results in a de novo expression of polypeptides having the enzymatic activities of
(i) phosphoglycolate phosphatase,
(ii) glyoxylate reductase,
(iii) erythro-β-hydroxyaspartate aldolase belonging to the EC class 4.1.3.14,
(iv) erythro-β-hydroxyaspartate dehydratase belonging to the EC class 4.3.1.20,
(v) iminosuccinate reductase and
(vi) aspartate-glyoxylate transaminase,
wherein the polypeptide having the enzymatic activity of (v) iminosuccinate reductase comprises the conserved amino acid sequence of comprising the conserved amino acid sequence of $GX_aKX_aG(X_a)_8GX_aKX_aGG(X_a)_2PX_aN(X_a)_7$ $NHQS(X_a)_3LF(X_a)_4G(X_a)_8N(X_a)_2TAX_aRTAA(X_a)_4S(X_a)_3$ $L(X_a)_8G(X_a)_2GAGX_aQ(X_a)_3Q(X_a)_{15}WN(X_a)_{39}S(X_a)_{15}H$ $(X_a)_3MGTDT(X_a)_2KX_aE(X_a)_{13}D(X_a)_3Q(X_a)_4GEX_a$- $Q(X_a)_{16}G(X_a)_9R(X_a)_6T(X_a)_2DGX_aG(X_a)_3QDX_aA$ (SEQ ID NO: 663), wherein $X_a$ represents independently for each occurrence an amino acid;
and the polypeptide having the enzymatic activity of (vi) aspartate-glyoxylate transaminase comprises the conserved amino acid sequence of $W(X_b)_{12}L(X_b)_2D(X_b)_{12}$ $NETX_bTGVX_bS(X_b)_{20}DX_bVSS(X_b)_5F(X_b)_4W(X_b)_2D(X_b)_4$ $GSQKGX_bM(X_b)_3G(X_b)_{38}PX_bTP(X_b)_6G(X_b)_{11}E(X_b)_7RH$ $(X_b)_3A(X_b)_3R(X_b)_5W(X_b)_5A(X_b)_6S(X_b)_8P(X_b)_{20}GX_bG$ $(X_b)_8FRX_bGHX_bG(X_b)_{14}E(X_b)_{12}GX_bG(X_b)_2AA$ (SEQ ID NO: 664), wherein $X_b$ represents independently for each occurrence an amino acid; and
wherein the nucleic acids encoding the polypeptides having the enzymatic activities of (i) phosphoglycolate phosphatase, (ii) glyoxylate reductase, (iii) erythro-β-hydroxyaspartate aldolase, (iv) erythro-β-hydroxyaspartate dehydratase, (v) iminosuccinate reductase and (vi) aspartate-glyoxylate transaminase comprise a polynucleotide sequence of at least 80% sequence identity to SEQ ID NOs: 43-46, 62 and 64.

In one embodiment, the method for the production of autotrophic microorganisms with altered photorespiration and improved $CO_2$ fixation comprises introducing into the autotrophic microorganism one or more nucleic acids encoding polypeptides having the enzymatic activities of
(i) phosphoglycolate phosphatase,
(ii) glyoxylate reductase,
(iii) erythro-β-hydroxyaspartate aldolase belonging to the EC class 4.1.3.14,
(iv) erythro-β-hydroxyaspartate dehydratase belonging to the EC class 4.3.1.20,
(v) iminosuccinate reductase and
(vi) aspartate-glyoxylate transaminase,
wherein the introduction of the nucleic acid(s) results in a de novo expression of polypeptides having the enzymatic activities of
(i) phosphoglycolate phosphatase,
(ii) glyoxylate reductase,
(iii) erythro-β-hydroxyaspartate aldolase belonging to the EC class 4.1.3.14,
(iv) erythro-β-hydroxyaspartate dehydratase belonging to the EC class 4.3.1.20,
(v) iminosuccinate reductase and
(vi) aspartate-glyoxylate transaminase,
wherein the polypeptide having the enzymatic activity of (v) iminosuccinate reductase comprises an amino acid sequence of preferably at least 60% sequence identity to a sequence selected from SEQ ID NOs: 2 or 66-363, more preferably at least 80% sequence identity to a sequence selected from SEQ ID NOs: 2 or 66-363, preferably at least 90% sequence identity to a sequence selected from SEQ ID NOs: 2 or 66-363, preferably at least 95% sequence identity to a sequence selected from SEQ ID NOs: 2 or 66-363, preferably at least 97% sequence identity to a sequence selected from SEQ ID NOs: 2 or 66-363, preferably at least 98% sequence identity to a sequence selected from SEQ ID NOs: 2 or 66-363, preferably at least 99% sequence identity to a sequence selected from SEQ ID NOs: 2 or 66-363, preferably at least 100% sequence identity to a sequence selected from SEQ ID NOs: 2 or 66-363;
and the polypeptide having the enzymatic activity of (vi) aspartate-glyoxylate transaminase comprises the conserved amino acid sequence of $W(X_b)_{12}L(X_b)_2D(X_b)_{12}$ $NETX_bTGVX_bS(X_b)_{20}DX_bVSS(X_b)_5F(X_b)_4W(X_b)_2D(X_b)_4$ $GSQKGX_bM(X_b)_3G(X_b)_{38}PX_bTP(X_b)_6G(X_b)_{11}E(X_b)_7RH$ $(X_b)_3A(X_b)_3R(X_b)_5W(X_b)_5A(X_b)_6S(X_b)_8P(X_b)_{20}GX_bG$ $(X_b)_8FRX_bGHX_bG(X_b)_{14}E(X_b)_{12}GX_bG(X_b)_2AA$ (SEQ ID NO: 664), wherein $X_b$ represents independently for each occurrence an amino acid.

Preferably, in the inventive methods described herein, the de novo expressed polypeptide having the enzymatic activity of (i) phosphoglycolate phosphatase comprises an amino acid sequence having at least 80% sequence identity to SEQ ID NO: 63, the de novo expressed polypeptide having the enzymatic activity of (ii) glyoxylate reductase comprises an amino acid sequence having at least 80% sequence identity to SEQ ID NO: 65, the de novo expressed polypeptide having the enzymatic activity of (iii) erythro-β-hydroxyaspartate aldolase comprises an amino acid sequence having at least 80% sequence identity to SEQ ID NO: 4, the de novo expressed polypeptide having the enzymatic activity of (iv) erythro-β-hydroxyaspartate dehydratase comprises an amino acid sequence having at least 80% sequence identity to SEQ ID NO: 6, the de novo expressed polypeptide having the enzymatic activity of (v) iminosuccinate reductase comprises an amino acid sequence having at least 80% sequence identity to a sequence selected from SEQ ID NOs: 2 or 66-363 and the de novo expressed polypeptide having the enzymatic activity of (vi) aspartate-glyoxylate transaminase comprises an amino acid sequence having at least 80% sequence identity to a sequence selected from SEQ ID NOs: 8 or 364-662.

More preferably, in the inventive methods described herein, the de novo expressed polypeptide having the enzymatic activity of (i) phosphoglycolate phosphatase comprises an amino acid sequence having at least 90% sequence identity to SEQ ID NO: 63, the de novo expressed polypeptide having the enzymatic activity of (ii) glyoxylate reductase comprises an amino acid sequence having at least 90% sequence identity to SEQ ID NO: 65, the de novo expressed polypeptide having the enzymatic activity of (iii) erythro-β-hydroxyaspartate aldolase comprises an amino acid sequence having at least 90% sequence identity to SEQ ID NO: 4, the de novo expressed polypeptide having the enzymatic activity of (iv) erythro-β-hydroxyaspartate dehydratase comprises an amino acid sequence having at least 90% sequence identity to SEQ ID NO: 6, the de novo expressed polypeptide having the enzymatic activity of (v) iminosuccinate reductase comprises an amino acid sequence having at least 90% sequence identity to a sequence selected from SEQ ID NOs: 2 or 66-363 and the de novo expressed polypeptide having the enzymatic activity of (vi) aspartate-glyoxylate transaminase comprises an amino acid sequence having at least 90% sequence identity to a sequence selected from SEQ ID NOs: 8 or 364-662.

Even more preferably, in the inventive methods described herein, the de novo expressed polypeptide having the enzymatic activity of (i) phosphoglycolate phosphatase comprises an amino acid sequence having at least 95% sequence identity to SEQ ID NO: 63, the de novo expressed polypeptide having the enzymatic activity of (ii) glyoxylate reductase comprises an amino acid sequence having at least 95% sequence identity to SEQ ID NO: 65, the de novo expressed polypeptide having the enzymatic activity of (iii) erythro-β-hydroxyaspartate aldolase comprises an amino acid sequence having at least 95% sequence identity to SEQ ID NO: 4, the de novo expressed polypeptide having the enzymatic activity of (iv) erythro-β-hydroxyaspartate dehydratase comprises an amino acid sequence having at least 95% sequence identity to SEQ ID NO: 6, the de novo expressed polypeptide having the enzymatic activity of (v) iminosuccinate reductase comprises an amino acid sequence having at least 95% sequence identity to a sequence selected from SEQ ID NOs: 2 or 66-363 and the de novo expressed polypeptide having the enzymatic activity of (vi) aspartate-glyoxylate transaminase comprises an amino acid sequence having at least 95% sequence identity to a sequence selected from SEQ ID NOs: 8 or 364-662.

Even more preferably, in the inventive methods described herein, the de novo expressed polypeptide having the enzymatic activity of (i) phosphoglycolate phosphatase comprises an amino acid sequence having at least 97% sequence identity to SEQ ID NO: 63, the de novo expressed polypeptide having the enzymatic activity of (ii) glyoxylate reductase comprises an amino acid sequence having at least 97% sequence identity to SEQ ID NO: 65, the de novo expressed polypeptide having the enzymatic activity of (iii) erythro-β-hydroxyaspartate aldolase comprises an amino acid sequence having at least 97% sequence identity to SEQ ID NO: 4, the de novo expressed polypeptide having the enzymatic activity of (iv) erythro-β-hydroxyaspartate dehydratase comprises an amino acid sequence having at least 97% sequence identity to SEQ ID NO: 6, the de novo expressed polypeptide having the enzymatic activity of (v) iminosuccinate reductase comprises an amino acid sequence having at least 97% sequence identity to a sequence selected from SEQ ID NOs: 2 or 66-363 and the de novo expressed polypeptide having the enzymatic activity of (vi) aspartate-glyoxylate transaminase comprises an amino acid sequence having at least 97% sequence identity to a sequence selected from SEQ ID NOs: 8 or 364-662.

More preferably, in the inventive methods described herein, the de novo expressed polypeptide having the enzymatic activity of (i) phosphoglycolate phosphatase comprises an amino acid sequence having at least 99% sequence identity to SEQ ID NO: 63, the de novo expressed polypeptide having the enzymatic activity of (ii) glyoxylate reductase comprises an amino acid sequence having at least 99% sequence identity to SEQ ID NO: 65, the de novo expressed polypeptide having the enzymatic activity of (iii) erythro-β-hydroxyaspartate aldolase comprises an amino acid sequence having at least 99% sequence identity to SEQ ID NO: 4, the de novo expressed polypeptide having the enzymatic activity of (iv) erythro-β-hydroxyaspartate dehydratase comprises an amino acid sequence having at least 99% sequence identity to SEQ ID NO: 6, the de novo expressed polypeptide having the enzymatic activity of (v) iminosuccinate reductase comprises an amino acid sequence having at least 99% sequence identity to a sequence selected from SEQ ID NOs: 2 or 66-363 and the de novo expressed polypeptide having the enzymatic activity of (vi) aspartate-glyoxylate transaminase comprises an amino acid sequence having at least 99% sequence identity to a sequence selected from SEQ ID NOs: 8 or 364-662.

More preferably, in the inventive methods described herein, the de novo expressed polypeptide having the enzymatic activity of (i) phosphoglycolate phosphatase comprises the amino acid sequence of SEQ ID NO: 63, the de novo expressed polypeptide having the enzymatic activity of (ii) glyoxylate reductase comprises the amino acid sequence of SEQ ID NO: 65, the de novo expressed polypeptide having the enzymatic activity of (iii) erythro-β-hydroxyaspartate aldolase comprises the amino acid sequence of SEQ ID NO: 4, the de novo expressed polypeptide having the enzymatic activity of (iv) erythro-β-hydroxyaspartate dehydratase comprises the amino acid sequence of SEQ ID NO: 6, the de novo expressed polypeptide having the enzymatic activity of (v) iminosuccinate reductase comprises the amino acid sequence selected from SEQ ID NOs: 2 or 66-363 and the de novo expressed polypeptide having the enzymatic activity of (vi) aspartate-glyoxylate transaminase comprises the amino acid sequence selected from SEQ ID NOs: 8 or 364-662.

In another embodiment of the present invention, the method for the production of autotrophic microorganisms with altered photorespiration and improved $CO_2$ fixation comprises introducing into the autotrophic microorganism one or more nucleic acids encoding polypeptides having the enzymatic activities of
  (i) phosphoglycolate phosphatase,
  (ii) glyoxylate reductase,
  (iii) erythro-β-hydroxyaspartate aldolase belonging to the EC class 4.1.3.14,
  (iv) erythro-β-hydroxyaspartate dehydratase belonging to the EC class 4.3.1.20,
  (v) iminosuccinate reductase and
  (vi) aspartate-glyoxylate transaminase,
wherein the one or more nucleic acid(s) comprise(s) a polynucleotide sequence of at least 80% sequence identity to SEQ ID NOs: 1, 3, 5, 7, 62 and 64 or SEQ ID NOs: 43-46, 62 and 64,
wherein the introduction of the nucleic acid(s) results in a de novo expression of polypeptides having the enzymatic activities of
  (i) phosphoglycolate phosphatase,
  (ii) glyoxylate reductase,
  (iii) erythro-β-hydroxyaspartate aldolase belonging to the EC class 4.1.3.14,
  (iv) erythro-β-hydroxyaspartate dehydratase belonging to the EC class 4.3.1.20,
  (v) iminosuccinate reductase and
  (vi) aspartate-glyoxylate transaminase,
wherein the polypeptide having the enzymatic activity of (i) phosphoglycolate phosphatase comprises an amino acid sequence having at least 80% sequence identity to SEQ ID NO: 63, the polypeptide having the enzymatic activity of (ii) glyoxylate reductase comprises an amino acid sequence having at least 80% sequence identity to SEQ ID NO: 65, the polypeptide having the enzymatic activity of (iii) erythro-β-hydroxyaspartate aldolase comprises an amino acid sequence having at least 80% sequence identity to SEQ ID NO: 2, the polypeptide having the enzymatic activity of (iv) erythro-β-hydroxyaspartate dehydratase comprises an amino acid sequence having at least 80% sequence identity to SEQ ID NO: 4, the polypeptide having the enzymatic activity of (v) iminosuccinate reductase comprises an amino acid sequence having at least 80% sequence identity to SEQ ID NO: 6 and the polypeptide having the enzymatic activity of (vi) aspartate-glyoxylate transaminase comprises an amino acid sequence having at least 80% sequence identity to SEQ ID NO: 8.

In another embodiment, the method for the production of autotrophic microorganisms with altered photorespiration and improved $CO_2$ fixation comprises introducing into the autotrophic microorganism one or more nucleic acids encoding polypeptides having the enzymatic activities of
 (i) phosphoglycolate phosphatase,
 (ii) glyoxylate reductase,
 (iii) erythro-β-hydroxyaspartate aldolase belonging to the EC class 4.1.3.14,
 (iv) erythro-β-hydroxyaspartate dehydratase belonging to the EC class 4.3.1.20,
 (v) iminosuccinate reductase and
 (vi) aspartate-glyoxylate transaminase,
wherein the introduction of the nucleic acid(s) results in a de novo expression of polypeptides having the enzymatic activities of
 (i) phosphoglycolate phosphatase,
 (ii) glyoxylate reductase,
 (iii) erythro-β-hydroxyaspartate aldolase belonging to the EC class 4.1.3.14,
 (iv) erythro-β-hydroxyaspartate dehydratase belonging to the EC class 4.3.1.20,
 (v) iminosuccinate reductase and
 (vi) aspartate-glyoxylate transaminase,
wherein the polypeptide having the enzymatic activity of (v) iminosuccinate reductase comprises the conserved amino acid sequence of comprising the conserved amino acid sequence of $GX_aKX_aG(X_a)_8GX_aKX_aGG(X_a)_2PX_aN(X_a)_7NHQS(X_a)_3LF(X_a)_4G(X_a)_8N(X_a)_2TAX_aRTAA(X_a)_4S(X_a)_3L(X_a)_8G(X_a)_2GAGX_aQ(X_a)_3Q(X_a)_{15}WN(X_a)_{39}S(X_a)_{15}H(X_a)_3MGTDT(X_a)_2KX_aE(X_a)_{13}D(X_a)_3Q(X_a)_4GEX_a-Q(X_a)_{16}G(X_a)_9R(X_a)_6T(X_a)_2DGX_aG(X_a)_3QDX_aA$ (SEQ ID NO: 663), wherein $X_a$ represents independently for each occurrence an amino acid; and
the polypeptide having the enzymatic activity of (vi) aspartate-glyoxylate transaminase comprises the conserved amino acid sequence of $X^4X^7X_cX^6X_cX^9X^4X_cX_cX_cX^4-X_cX_cX_cWX^9X_cX^7X^4X^7X_cX_cX_cX^4X^9X^9X_cLX_cX_cDX_cX_c-X_cX_cX^4X^5X^5X^5X^2X^4X^7X^7X^5NETX^8TGVX_cSX^5X^2X^9X_cX^4-X^9X^9X_cX^4X_cX_cX_cX_cX^5X_cX^8X^4X^4X^4X^2DX^7VSSX^2X^8X^7-X^4X_cFX^9X_cX^9X^9WX_cX^2DX^4X^7X^2X^7GSQKGX^4MX^4X_c-X^7GX^4X^7X^4X^4X^7X^4X^8X_cX^4X^8X_cX_cX_cX_cX_cX^7X_cX^4-X_cX^5X^4X^3X^4X^9X^4X^9X^9X_cX_cX_cX_cX_cX_cX_cX_cX^4PX_c-TPXA_cX^9X^4X^4X_cGX^4X_cX_cX^7X_cX^9X_cX^4X_cX_cX^9EX^9X^4-X_cX^9X^2X^4X^9RHX_cX^4X^4AX^9X^8X^4RX_cX^8X^4X_cX^8WX^9X^4X_cX_cX^4AX_cX^9X_cX^9X_cX_cSX_cX^1X^2X^1X^7X^2X_cX^4PX_cX^9X^4X^5X^8X_cX_cX^4X^4X^9X_cX^7X_cX_cX_cX^3X^9X^4X^8X^4GX_cGX_4X_cX_cX^4X_cX^7X^5X^4FRX^2GHX^2GX_cX^4X^7X_cX_cX_cX^4X_cX_cX^8X^2X^7X_cX^4EX^4X^7X^4X^4X^9X_cX^9X^4X_cX^4X_cX_cGX_cGX^7X_cAAX_cX^9X_cX^4$ (SEQ ID NO 665), wherein $X_c$ represents independently for each occurrence an amino acid;

$X^1$ represents independently for each occurrence S or T,
$X^2$ represents independently for each occurrence I, L or V,
$X^3$ represents independently for each occurrence F, H, W or Y,
$X^4$ represents independently for each occurrence A, C, F, G, H, I, K, L, M, R, T, V, W or Y,
$X^5$ represents independently for each occurrence C, D, E, H, K, N, Q, R, S or T,
$X^6$ represents independently for each occurrence H, K or R,
$X^7$ represents independently for each occurrence A, C, D, G, N, P, S, T or V,
$X^8$ represents independently for each occurrence A, G or S,
$X^9$ represents independently for each occurrence A, C, D, E, G, H, K, N, Q, R, S or T.

In another embodiment, the method for the production of autotrophic microorganisms with altered photorespiration and improved $CO_2$ fixation comprises introducing into the autotrophic microorganism one or more nucleic acids encoding polypeptides having the enzymatic activities of (i) phosphoglycolate phosphatase,
(ii) glyoxylate reductase,
(iii) erythro-β-hydroxyaspartate aldolase belonging to the EC class 4.1.3.14,
(iv) erythro-β-hydroxyaspartate dehydratase belonging to the EC class 4.3.1.20,
(v) iminosuccinate reductase and
(vi) aspartate-glyoxylate transaminase, wherein the introduction of the nucleic acid(s) results in a de novo expression of polypeptides having the enzymatic activities of (i) phosphoglycolate phosphatase,
(ii) glyoxylate reductase,
(iii) erythro-β-hydroxyaspartate aldolase belonging to the EC class 4.1.3.14,
(iv) erythro-β-hydroxyaspartate dehydratase belonging to the EC class 4.3.1.20,
(v) iminosuccinate reductase and
(vi) aspartate-glyoxylate transaminase, wherein the polypeptide having the enzymatic activity of (v) iminosuccinate reductase comprises the conserved amino acid sequence of comprising the conserved amino acid sequence of $GX_aKX_aG(X_a)_8GX_aKX_aGG(X_a)_2PX_aN(X_a)_7NHQS(X_a)_3LF(X_a)_4G(X_a)_8N(X_a)_2TAX_aRTAA(X_a)_4S(X_a)_3L(X_a)_8G(X_a)_2GAGX_aQ(X_a)_3Q(X_a)_{15}WN(X_a)_{39}S(X_a)_{15}H(X_a)_3MGTDT(X_a)_2KX_aE(X_a)_{13}D(X_a)_3Q(X_a)_4GEX_aQ(X_a)_{16}G(X_a)_9R(X_a)_6T(X_a)_2DGX_aG(X_a)_3QDX_aA$ (SEQ ID NO: 663), wherein $X_a$ represents independently for each occurrence an amino acid;

and the polypeptide having the enzymatic activity of (vi) aspartate-glyoxylate transaminase comprises an amino acid sequence of at least 80% sequence identity to a sequence selected from SEQ ID NOs: 8, or 364-662.

The method of the present invention can be applied to any autotrophic microorganism using the enzyme RubisCO for fixation of carbon dioxide, including, but not limited to, microalgae, eukaryotic microorganism, prokaryotic microorganism, bacteria, including cyanobacteria, proteobacteria, purple bacteria, green sulfur bacteria, halophiles or methanogens.

Thus, in one embodiment of the present invention, the method for the production of autotrophic microorganisms with altered photorespiration and improved $CO_2$ fixation comprises introducing into the autotrophic microorganism one or more nucleic acids encoding polypeptides having the enzymatic activities of (i) phosphoglycolate phosphatase,
(ii) glyoxylate reductase,
(iii) erythro-β-hydroxyaspartate aldolase belonging to the EC class 4.1.3.14,
(iv) erythro-β-hydroxyaspartate dehydratase belonging to the EC class 4.3.1.20,
(v) iminosuccinate reductase and
(vi) aspartate-glyoxylate transaminase, wherein the introduction of the nucleic acid(s) results in a de novo expression of polypeptides having the enzymatic activities of
(i) phosphoglycolate phosphatase,
(ii) glyoxylate reductase,
(iii) erythro-β-hydroxyaspartate aldolase belonging to the EC class 4.1.3.14,
(iv) erythro-β-hydroxyaspartate dehydratase belonging to the EC class 4.3.1.20,
(v) iminosuccinate reductase and
(vi) aspartate-glyoxylate transaminase, wherein the polypeptide having the enzymatic activity of (v) iminosuccinate reductase comprises the conserved amino acid sequence of comprising the conserved amino acid sequence of $GX_aKX_aG(X_a)_8GX_aKX_aGG(X_a)_2PX_aN(X_a)_7NHQS(X_a)_3LF(X_a)_4G(X_a)_8N(X_a)_2TAX_aRTAA(X_a)_4S(X_a)_3L(X_a)_8G(X_a)_2GAGX_aQ(X_a)_3Q(X_a)_{15}WN(X_a)_{39}S(X_a)_{15}H(X_a)_3MGTDT(X_a)_2KX_aE(X_a)_{13}D(X_a)_3Q(X_a)_4GEX_a-Q(X_a)_{16}G(X_a)_9R(X_a)_6T(X_a)_2DGX_aG(X_a)_3QDX_aA$ (SEQ ID NO: 663), wherein $X_a$ represents independently for each occurrence an amino acid;

and the polypeptide having the enzymatic activity of (vi) aspartate-glyoxylate transaminase comprises the conserved amino acid sequence of $W(X_b)_{12}L(X_b)_2D(X_b)_{12}NETX_bTGVX_bS(X_b)_{20}DX_bVSS(X_b)_5F(X_b)_4W(X_b)_2D(X_b)_4GSQKGX_bM(X_b)_3G(X_b)_{38}PX_bTP(X_b)_6G(X_b)_{11}E(X_b)_7RH(X_b)_3A(X_b)_3R(X_b)_5W(X_b)_5A(X_b)_6S(X_b)_8P(X_b)_{20}GX_bG(X_b)_8FRX_bGHX_bG(X_b)_{14}E(X_b)_{12}GX_bG(X_b)_2AA$ (SEQ ID NO: 664), wherein $X_b$ represents independently for each occurrence an amino acid; and wherein the autotrophic microorganism is selected from microalgae, eukaryotic microorganisms, prokaryotic microorganisms, bacteria, including cyanobacteria, proteobacteria, purple bacteria, green sulfur bacteria, halophiles or methanogens.

In one embodiment of the present invention, the method for the production of autotrophic microorganisms with altered photorespiration and improved $CO_2$ fixation comprises introducing into the autotrophic microorganism one or more nucleic acids encoding polypeptides having the enzymatic activities of
(i) phosphoglycolate phosphatase,
(ii) glyoxylate reductase,
(iii) erythro-β-hydroxyaspartate aldolase belonging to the EC class 4.1.3.14,
(iv) erythro-β-hydroxyaspartate dehydratase belonging to the EC class 4.3.1.20,
(v) iminosuccinate reductase and
(vi) aspartate-glyoxylate transaminase, wherein the introduction of the nucleic acid(s) results in a de novo expression of polypeptides having the enzymatic activities of
(i) phosphoglycolate phosphatase,
(ii) glyoxylate reductase,
(iii) erythro-β-hydroxyaspartate aldolase belonging to the EC class 4.1.3.14,
(iv) erythro-β-hydroxyaspartate dehydratase belonging to the EC class 4.3.1.20,
(v) iminosuccinate reductase and
(vi) aspartate-glyoxylate transaminase, wherein the polypeptide having the enzymatic activity of (v) iminosuccinate reductase comprises the conserved amino acid sequence of comprising the conserved amino acid sequence of $GX_aKX_aG(X_a)_8GX_aKX_aGG(X_a)_2PX_aN(X_a)_7NHQS(X_a)_3LF(X_a)_4G(X_a)_8N(X_a)_2TAX_aRTAA(X_a)_4S(X_a)_3L(X_a)_8G(X_a)_2GAGX_aQ(X_a)_3Q(X_a)_{15}WN(X_a)_{39}S(X_a)_{15}H(X_a)_3MGTDT(X_a)_2KX_aE(X_a)_{13}D(X_a)_3Q(X_a)_4GEX_a-Q(X_a)_{16}G(X_a)_9R(X_a)_6T(X_a)_2DGX_aG(X_a)_3QDX_aA$ (SEQ ID NO: 663), wherein $X_a$ represents independently for each occurrence an amino acid;

and the polypeptide having the enzymatic activity of (vi) aspartate-glyoxylate transaminase comprises the conserved amino acid sequence of $W(X_b)_{12}L(X_b)_2D(X_b)_{12}NETX_bTGVX_bS(X_b)_{20}DX_bVSS(X_b)_5F(X_b)_4W(X_b)_2D(X_b)_4GSQKGX_bM(X_b)_3G(X_b)_{38}PX_bTP(X_b)_6G(X_b)_{11}E(X_b)_7RH(X_b)_3A(X_b)_3R(X_b)_5W(X_b)_5A(X_b)_6S(X_b)_8P(X_b)_{20}GX_bG(X_b)_8FRX_bGHX_bG(X_b)_{14}E(X_b)_{12}GX_bG(X_b)_2AA$ (SEQ ID NO: 664), wherein $X_b$ represents independently for each occurrence an amino acid; and wherein the autotrophic microorganism is selected from *Arthrospira platensis, Arthrospira maxima, Chlorella vulgaris, Dunaliella tertiolecta, Dunaliella salina, Tetraselmis maculata, Euglena gracilis, Scenedesmus obliquus, Cupriavidus necator, Chlamydomonas reinhardtii, Thalassiosira pseudonana, Nannochloropsis oculata, Skeletonema marinoi* and *Chaetoceros muelleri*.

In a further embodiment, the method for the production of autotrophic microorganisms with altered photorespiration and improved $CO_2$ fixation comprises introducing into the autotrophic microorganism one or more nucleic acids encoding polypeptides having the enzymatic activities of
(i) phosphoglycolate phosphatase,
(ii) glyoxylate reductase,
(iii) erythro-β-hydroxyaspartate aldolase belonging to the EC class 4.1.3.14,
(iv) erythro-β-hydroxyaspartate dehydratase belonging to the EC class 4.3.1.20,
(v) iminosuccinate reductase and
(vi) aspartate-glyoxylate transaminase, wherein the introduction of the nucleic acid(s) results in a de novo expression of polypeptides having the enzymatic activities of
(i) phosphoglycolate phosphatase,
(ii) glyoxylate reductase,
(iii) erythro-β-hydroxyaspartate aldolase belonging to the EC class 4.1.3.14,
(iv) erythro-β-hydroxyaspartate dehydratase belonging to the EC class 4.3.1.20,
(v) iminosuccinate reductase and
(vi) aspartate-glyoxylate transaminase, wherein the polypeptide having the enzymatic activity of (v) iminosuccinate reductase comprises the conserved amino acid sequence of comprising the conserved amino acid sequence of $GX_aKX_aG(X_a)_8GX_aKX_aGG(X_a)_2PX_aN(X_a)_7NHQS(X_a)_3LF(X_a)_4G(X_a)_8N(X_a)_2TAX_aRTAA(X_a)_4S(X_a)_3L(X_a)_8G(X_a)_2GAGX_aQ(X_a)_3Q(X_a)_{15}WN(X_a)_{39}S(X_a)_{15}H(X_a)_3MGTDT(X_a)_2KX_aE(X_a)_{13}D(X_a)_3Q(X_a)_4GEX_a-Q(X_a)_{16}G(X_a)_9R(X_a)_6T(X_a)_2DGX_aG(X_a)_3QDX_aA$ (SEQ ID NO: 663), wherein $X_a$ represents independently for each occurrence an amino acid;

and the polypeptide having the enzymatic activity of (vi) aspartate-glyoxylate transaminase comprises the conserved amino acid sequence of $W(X_b)_{12}L(X_b)_2D(X_b)_{12}NETX_bTGVX_bS(X_b)_{20}DX_bVSS(X_b)_5F(X_b)_4W(X_b)_2D(X_b)_4GSQKGX_bM(X_b)_3G(X_b)_{38}PX_bTP(X_b)_6G(X_b)_{11}E(X_b)_7RH(X_b)_3A(X_b)_3R(X_b)_5W(X_b)_5A(X_b)_6S(X_b)_8P(X_b)_{20}GX_bG(X_b)_8FRX_bGHX_bG(X_b)_{14}E(X_b)_{12}GX_bG(X_b)_2AA$ (SEQ ID NO: 664), wherein $X_b$ represents independently for each occurrence an amino acid; and wherein the autotrophic microorganism is a cyanobacterium.

The skilled person in the art may readily envision, that the expression of a (i) phosphoglycolate phosphatase is not required for all autotrophic microorganisms in order to bypass the photorespiration pathway since some autotrophic microorganism naturally express a phosphoglycolate phosphatase capable of hydrolyzing 2-phosphoglycolate. Thus, in one embodiment of the present invention, the method for the production of autotrophic microorganisms with altered photorespiration and improved $CO_2$ fixation comprises introducing into the autotrophic microorganism one or more nucleic acids encoding polypeptides having the enzymatic activities of (ii) glyoxylate reductase,
(iii) erythro-β-hydroxyaspartate aldolase belonging to the EC class 4.1.3.14,
(iv) erythro-β-hydroxyaspartate dehydratase belonging to the EC class 4.3.1.20,
(v) iminosuccinate reductase and
(vi) aspartate-glyoxylate transaminase, wherein the introduction of the nucleic acid(s) results in a de novo expression of polypeptides having the enzymatic activities of (ii) glyoxylate reductase,
(iii) erythro-β-hydroxyaspartate aldolase belonging to the EC class 4.1.3.14,
(iv) erythro-β-hydroxyaspartate dehydratase belonging to the EC class 4.3.1.20,
(v) iminosuccinate reductase and
(vi) aspartate-glyoxylate transaminase, wherein the polypeptide having the enzymatic activity of (v) iminosuccinate reductase comprises the conserved amino acid sequence of comprising the conserved amino acid sequence of $GX_aKX_aG(X_a)_8GX_aKX_aGG(X_a)_2PX_aN(X_a)_7NHQS(X_a)_3LF(X_a)_4G(X_a)_8N(X_a)_2TAX_aRTAA(X_a)_4S(X_a)_3L(X_a)_8G(X_a)_2GAGX_aQ(X_a)_3Q(X_a)_{15}WN(X_a)_{39}S(X_a)_{15}H(X_a)_3MGTDT(X_a)_2KX_aE(X_a)_{13}D(X_a)_3Q(X_a)_4GEX_a-Q(X_a)_{16}G(X_a)_9R(X_a)_6T(X_a)_2DGX_aG(X_a)_3QDX_aA$ (SEQ ID NO: 663), wherein $X_a$ represents independently for each occurrence an amino acid;

and the polypeptide having the enzymatic activity of (vi) aspartate-glyoxylate transaminase comprises the conserved amino acid sequence of $W(X_b)_{12}L(X_b)_2D(X_b)_{12}NETX_bTGVX_bS(X_b)_{20}DX_bVSS(X_b)_5F(X_b)_4W(X_b)_2D(X_b)_4GSQKGX_bM(X_b)_3G(X_b)_{38}PX_bTP(X_b)_6G(X_b)_{11}E(X_b)_7RH(X_b)_3A(X_b)_3R(X_b)_5W(X_b)_5A(X_b)_6S(X_b)_8P(X_b)_{20}GX_bG(X_b)_8FRX_bGHX_bG(X_b)_{14}E(X_b)_{12}GX_bG(X_b)_2AA$ (SEQ ID NO: 664), wherein $X_b$ represents independently for each occurrence an amino acid.

Moreover, the skilled person in the art may readily envision, that the enzymes glycolate oxidase (GO; EC 1.1.3.15) and glycolate dehydrogenase (GDH; EC 1.1.99.14) are capable of oxidizing glycolate to glyoxylate, thereby can replace the (ii) glyoxylate reductase. In case glycolate oxidase is used, a catalase enzyme (CAT; EC 1.11.1.7) must be expressed, too, in order to convert the toxic hydrogen peroxide. Thus, in one embodiment of the present invention, the method for the production of autotrophic microorganisms with altered photorespiration and improved $CO_2$ fixation comprises introducing into the autotrophic microorganism one or more nucleic acids encoding polypeptides having the enzymatic activities of (ii') glycolate oxidase and catalase, glyoxylate reductase or glycolate dehydrogenase,
(iii) erythro-β-hydroxyaspartate aldolase belonging to the EC class 4.1.3.14,
(iv) erythro-β-hydroxyaspartate dehydratase belonging to the EC class 4.3.1.20,
(v) iminosuccinate reductase and
(vi) aspartate-glyoxylate transaminase, wherein the introduction of the nucleic acid(s) results in a de novo expression of polypeptides having the enzymatic activities of (ii') glycolate oxidase and catalase, glyoxylate reductase or glycolate dehydrogenase,
(iii) erythro-β-hydroxyaspartate aldolase belonging to the EC class 4.1.3.14,
(iv) erythro-β-hydroxyaspartate dehydratase belonging to the EC class 4.3.1.20,
(v) iminosuccinate reductase and
(vi) aspartate-glyoxylate transaminase, wherein the polypeptide having the enzymatic activity of (v) iminosuccinate reductase comprises the conserved amino acid sequence of comprising the conserved amino acid sequence of $GX_aKX_aG(X_a)_8GX_aKX_aGG(X_a)_2PX_aN(X_a)_7NHQS(X_a)_3LF(X_a)_4G(X_a)_8N(X_a)_2TAX_aRTAA(X_a)_4S(X_a)_3L(X_a)_8G(X_a)_2GAGX_aQ(X_a)_3Q(X_a)_{15}WN(X_a)_{39}S(X_a)_{15}H(X_a)_3MGTDT(X_a)_2KX_aE(X_a)_{13}D(X_a)_3Q(X_a)_4GEX_a-Q(X_a)_{16}G(X_a)_9R(X_a)_6T(X_a)_2DGX_aG(X_a)_3QDX_aA$ (SEQ ID NO: 663), wherein $X_a$ represents independently for each occurrence an amino acid;

and the polypeptide having the enzymatic activity of (vi) aspartate-glyoxylate transaminase comprises the conserved amino acid sequence of $W(X_b)_{12}L(X_b)_2D(X_b)_{12}NETX_bTGVX_bS(X_b)_{20}DX_bVSS(X_b)_5F(X_b)_4W(X_b)_2D(X_b)_4GSQKGX_bM(X_b)_3G(X_b)_{38}PX_bTP(X_b)_6G(X_b)_{11}E(X_b)_7RH(X_b)_3A(X_b)_3R(X_b)_5W(X_b)_5A(X_b)_6S(X_b)_8P(X_b)_{20}GX_bG(X_b)_8FRX_bGHX_bG(X_b)_{14}E(X_b)_{12}GX_bG(X_b)_2AA$ (SEQ ID NO: 664), wherein $X_b$ represents independently for each occurrence an amino acid.

In one embodiment of the present invention, the method for the production of autotrophic microorganisms with altered photorespiration and improved $CO_2$ fixation comprises introducing into the autotrophic microorganism one or more nucleic acids encoding polypeptides having the enzymatic activities of (i) phosphoglycolate phosphatase,
(ii') glycolate oxidase and catalase, glyoxylate reductase or glycolate dehydrogenase,
(iii) erythro-β-hydroxyaspartate aldolase belonging to the EC class 4.1.3.14,
(iv) erythro-β-hydroxyaspartate dehydratase belonging to the EC class 4.3.1.20,
(v) iminosuccinate reductase and
(vi) aspartate-glyoxylate transaminase, wherein the introduction of the nucleic acid(s) results in a de novo expression of polypeptides having the enzymatic activities of (i) phosphoglycolate phosphatase,
(ii') glycolate oxidase and catalase, glyoxylate reductase or glycolate dehydrogenase,
(iii) erythro-β-hydroxyaspartate aldolase belonging to the EC class 4.1.3.14,
(iv) erythro-β-hydroxyaspartate dehydratase belonging to the EC class 4.3.1.20,
(v) iminosuccinate reductase and
(vi) aspartate-glyoxylate transaminase, wherein the polypeptide having the enzymatic activity of (v) iminosuccinate reductase comprises the conserved amino acid sequence of comprising the conserved amino acid sequence of $GX_aKX_aG(X_a)_8GX_aKX_aGG(X_a)_2PX_aN(X_a)_7NHQS(X_a)_3LF(X_a)_4G(X_a)_8N(X_a)_2TAX_aRTAA(X_a)_4S(X_a)_3L(X_a)_8G(X_a)_2GAGX_aQ(X_a)_3Q(X_a)_{15}WN(X_a)_{39}S(X_a)_{15}H(X_a)_3MGTDT(X_a)_2KX_aE(X_a)_{13}D(X_a)_3Q(X_a)_4GEX_a$-$Q(X_a)_{16}G(X_a)_9R(X_a)_6T(X_a)_2DGX_aG(X_a)_3QDX_aA$ (SEQ ID NO: 663), wherein $X_a$ represents independently for each occurrence an amino acid;

and the polypeptide having the enzymatic activity of (vi) aspartate-glyoxylate transaminase comprises the conserved amino acid sequence of $W(X_b)_{12}L(X_b)_2D(X_b)_{12}NETX_bTGVX_bS(X_b)_{20}DX_bVSS(X_b)_5F(X_b)_4W(X_b)_2D(X_b)_4GSQKGX_bM(X_b)_3G(X_b)_{38}PX_bTP(X_b)_6G(X_b)_{11}E(X_b)_7RH(X_b)_3A(X_b)_3R(X_b)_5W(X_b)_5A(X_b)_6S(X_b)_8P(X_b)_{20}GX_bG(X_b)_8FRX_bGHX_bG(X_b)_{14}E(X_b)_{12}GX_bG(X_b)_2AA$ (SEQ ID NO: 664), wherein $X_b$ represents independently for each occurrence an amino acid.

The inventors could also show that the expression of the enzymes of the BHAP can be induced by increasing intracellular levels of glyoxylate, which acts as an effector of the β-hydroxyaspartate regulatory protein (see Example 3 and FIG. 4). Therefore, the expression of the β-hydroxyaspartate regulatory protein (BHAR) allows for the specific induction of the BHAP in autotrophic microorganisms by increasing intracellular levels of glyoxylate. Thus in one embodiment of the present invention, the method for the production of autotrophic microorganisms with altered photorespiration and improved $CO_2$ fixation comprises introducing into the autotrophic microorganism one or more nucleic acids encoding polypeptides having the enzymatic activities of (i) phosphoglycolate phosphatase,
(ii) glyoxylate reductase,
(iii) erythro-β-hydroxyaspartate aldolase belonging to the EC class 4.1.3.14,
(iv) erythro-β-hydroxyaspartate dehydratase belonging to the EC class 4.3.1.20,
(v) iminosuccinate reductase,
(vi) aspartate-glyoxylate transaminase and
(vii) β-hydroxyaspartate regulatory protein, wherein the introduction of the nucleic acid(s) results in a de novo expression of polypeptides having the enzymatic activities of (i) phosphoglycolate phosphatase,
(ii) glyoxylate reductase,
(iii) erythro-β-hydroxyaspartate aldolase belonging to the EC class 4.1.3.14,
(iv) erythro-β-hydroxyaspartate dehydratase belonging to the EC class 4.3.1.20,
(v) iminosuccinate reductase and
(vi) aspartate-glyoxylate transaminase and
(vii) β-hydroxyaspartate regulatory protein, wherein the polypeptide having the enzymatic activity of (v) iminosuccinate reductase comprises the conserved amino acid sequence of comprising the conserved amino acid sequence of $GX_aKX_aG(X_a)_8GX_aKX_aGG(X_a)_2PX_aN(X_a)_7NHQS(X_a)_3LF(X_a)_4G(X_a)_8N(X_a)_2TAX_aRTAA(X_a)_4S(X_a)_3L(X_a)_8G(X_a)_2GAGX_aQ(X_a)_3Q(X_a)_{15}WN(X_a)_{39}S(X_a)_{15}H(X_a)_3MGTDT(X_a)_2KX_aE(X_a)_{13}D(X_a)_3Q(X_a)_4GEX_a$-$Q(X_a)_{16}G(X_a)_9R(X_a)_6T(X_a)_2DGX_aG(X_a)_3QDX_aA$ (SEQ ID NO: 663), wherein $X_a$ represents independently for each occurrence an amino acid;

and the polypeptide having the enzymatic activity of (vi) aspartate-glyoxylate transaminase comprises the conserved amino acid sequence of $W(X_b)_{12}L(X_b)_2D(X_b)_{12}NETX_bTGVX_bS(X_b)_{20}DX_bVSS(X_b)_5F(X_b)_4W(X_b)_2D(X_b)_4GSQKGX_bM(X_b)_3G(X_b)_{38}PX_bTP(X_b)_6G(X_b)_{11}E(X_b)_7RH(X_b)_3A(X_b)_3R(X_b)_5W(X_b)_5A(X_b)_6S(X_b)_8P(X_b)_{20}GX_bG(X_b)_8FRX_bGHX_bG(X_b)_{14}E(X_b)_{12}GX_bG(X_b)_2AA$ (SEQ ID NO: 664), wherein $X_b$ represents independently for each occurrence an amino acid. Preferably the polypeptide having the enzymatic activity of (vii) β-hydroxyaspartate regulatory protein comprises the conserved amino acid sequence of $ET(X_d)_{23}R(X_d)_5G(X_d)_{10}G$ (SEQ ID NO: 965), wherein $X_d$ represents independently for each occurrence an amino acid. More preferably, the polypeptide having the enzymatic activity of (vii) β-hydroxyaspartate regulatory protein comprises an amino acid sequence having at least 80% sequence identity to a sequence selected from SEQ ID NOs: 10 and 666-964. More preferably, the polypeptide having the enzymatic activity of (vii) β-hydroxyaspartate regulatory protein comprises an amino acid sequence having at least 80% sequence identity to SEQ ID NO: 10. More preferably, the polypeptide having the enzymatic activity of (vii) β-hydroxyaspartate regulatory protein comprises an amino acid sequence selected from SEQ ID NOs: 10 and 666-964. More preferably, the polypeptide having the enzymatic activity of (vii) β-hydroxyaspartate regulatory protein comprises an amino acid sequence of SEQ ID NO: 10.

In one embodiment of the present invention, the method for the production of autotrophic microorganisms with altered photorespiration and improved $CO_2$ fixation comprises introducing into the autotrophic microorganism one or more nucleic acids encoding polypeptides having the enzymatic activities of (i) phosphoglycolate phosphatase,
(ii) glyoxylate reductase,
(iii) erythro-β-hydroxyaspartate aldolase belonging to the EC class 4.1.3.14,
(iv) erythro-β-hydroxyaspartate dehydratase belonging to the EC class 4.3.1.20,
(v) iminosuccinate reductase,
(vi) aspartate-glyoxylate transaminase and
(vii) β-hydroxyaspartate regulatory protein, wherein the one or more nucleic acid(s) comprise(s) a polynucleotide sequence of at least 80% sequence identity to SEQ ID NOs: 1, 3, 5, 7, 9, 62 and 64 or SEQ ID NOs: 43-47, 62 and 64 and wherein the introduction of the nucleic acid(s) results in a de novo expression of polypeptides having the enzymatic activities of (i) phosphoglycolate phosphatase,
(ii) glyoxylate reductase,
(iii) erythro-β-hydroxyaspartate aldolase belonging to the EC class 4.1.3.14,
(iv) erythro-β-hydroxyaspartate dehydratase belonging to the EC class 4.3.1.20,
(v) iminosuccinate reductase and
(vi) aspartate-glyoxylate transaminase and
(vii) β-hydroxyaspartate regulatory protein, wherein the polypeptide having the enzymatic activity of (i) phosphoglycolate phosphatase comprises an amino acid sequence having at least 80% sequence identity to SEQ ID NO: 63, the polypeptide having the enzymatic activity of (ii) glyoxylate reductase comprises an amino acid sequence having at least 80% sequence identity to SEQ ID NO: 65, the polypeptide having the enzymatic activity of (iii) erythro-β-hydroxyaspartate aldolase comprises an amino acid sequence having at least 80% sequence identity to SEQ ID NO: 2, the polypeptide having the enzymatic activity of (iv) erythro-β-hydroxyaspartate dehydratase comprises an amino acid sequence having at least 80% sequence identity to SEQ ID NO: 4, the polypeptide having the enzymatic activity of (v) iminosuccinate reductase comprises an amino acid sequence having at least 80% sequence identity to SEQ ID NO: 6, the polypeptide having the enzymatic activity of (vi) aspartate-glyoxylate transaminase comprises an amino acid sequence having at least 80% sequence identity to SEQ ID NO: 8 and the polypeptide having the enzymatic activity of (vii) β-hydroxyaspartate regulatory protein comprises an amino acid sequence having at least 80% sequence identity to SEQ ID NO: 10.

Another aspect of the present invention is directed to an autotrophic microorganism comprising one or more nucleic acids encoding polypeptides having the enzymatic activities of (i) phosphoglycolate phosphatase, (ii) glyoxylate reductase, (iii) erythro-β-hydroxyaspartate aldolase, (iv) erythro-β-hydroxyaspartate dehydratase, (v) iminosuccinate reductase and (vi) aspartate-glyoxylate transaminase; particularly to an autotrophic microorganism comprising one or more heterologous nucleic acids encoding polypeptides having the enzymatic activities of (i) phosphoglycolate phosphatase, (ii) glyoxylate reductase, (iii) erythro-β-hydroxyaspartate aldolase belonging to the EC class 4.1.3.14, (iv) erythro-β-hydroxyaspartate dehydratase belonging to the EC class 4.3.1.20, (v) iminosuccinate reductase having the conserved amino acid sequence of comprising the conserved amino acid sequence of $GX_aKX_aG(X_a)_8GX_aKX_aGG(X_a)_2PX_aN(X_a)_7NHQS(X_a)_3LF(X_a)_4G(X_a)_8N(X_a)_2TAX_aRTAA$ $(X_a)_4S(X_a)_3L(X_a)_8G(X_a)_2GAGX_aQ(X_a)_3$-$Q(X_a)_{15}WN(X_a)_{39}S(X_a)_{15}H(X_a)_3MGTDT(X_a)_2KX_aE$-$(X_a)_{13}D(X_a)_3Q(X_a)_4GEX_aQ(X_a)_{16}G(X_a)_9R(X_a)_6T(X_a)_2DGX_aG(X_a)_3QDX_aA$ (SEQ ID NO: 663), wherein $X_a$ represents independently for each occurrence an amino acid, and (vi) aspartate-glyoxylate transaminase having the conserved amino acid sequence of $W(X_b)_{12}L(X_b)_2D(X_b)_{12}NETX_bTGVX_bS(X_b)_{20}DX_bVSS(X_b)_5F(X_b)_4W(X_b)_2D(X_b)_4GSQKGX_bM(X_b)_3G(X_b)_{38}PX_bTP(X_b)_6G(X_b)_{11}E(X_b)_7RH(X_b)_3A(X_b)_3R(X_b)_5W(X_b)_5A(X_b)_6S(X_b)_8P(X_b)_{20}GX_bG(X_b)_8FRX_bGHX_bG(X_b)_{14}E(X_b)_{12}GX_bG(X_b)_2AA$ (SEQ ID NO: 664), wherein $X_b$ represents independently for each occurrence an amino acid.

The conserved amino acid sequence of SEQ ID NO: 663 consists of 251 amino acids, wherein each $X_a$ represents independently of each other exactly one amino acid and preferably one proteinogenic amino acids and more preferably exactly one canonic amino acid.

The conserved amino acid sequence of SEQ ID NO: 664 consists of 270 amino acids, wherein each $X_b$ represents independently of each other exactly one amino acid and preferably one proteinogenic amino acids and more preferably exactly one canonic amino acid.

Within the context of the present invention, heterologous nucleic acids refer to nucleic acids which are of different natural or of synthetic origin, such as derived from another microorganism. For instance, the autotrophic microorganism comprises a heterologous polynucleotide sequence derived from *P. denitrificans* (SEQ ID NOs: 1, 3, 5, 7, 62 and 64 or SEQ ID NOs: 43-46, 62 and 64), when the autotrophic microorganism is not *P. denitrificans*.

In one embodiment, the autotrophic microorganism comprises one or more heterologous nucleic acids encoding polypeptides having the enzymatic activities of (i) phosphoglycolate phosphatase, (ii) glyoxylate reductase, (iii) erythro-β-hydroxyaspartate aldolase belonging to the EC class 4.1.3.14, (iv) erythro-β-hydroxyaspartate dehydratase belonging to the EC class 4.3.1.20, (v) iminosuccinate reductase having the conserved amino acid sequence of comprising the conserved amino acid sequence of $GX_aKX_aG(X_a)_8GX_aKX_aGG(X_a)_2PX_aN(X_a)_7NHQS(X_a)_3LF(X_a)_4G(X_a)_8N(X_a)_2TAX_aRTAA$ $(X_a)_4S(X_a)_3L(X_a)_8G(X_a)_2GAGX_aQ(X_a)_3Q(X_a)_{15}WN(X_a)_{39}S(X_a)_{15}H(X_a)_3$ $MGTDT(X_a)_2KX_aE(X_a)_{13}D(X_a)_3Q(X_a)_4GEX_aQ(X_a)_{16}G(X_a)_9R(X_a)_6T(X_a)_2DGX_aG(X_a)_3QDX_aA$ (SEQ ID NO: 663), wherein $X_a$ represents independently for each occurrence an amino acid, and (vi) aspartate-glyoxylate transaminase having the conserved amino acid sequence of $W(X_b)_{12}L(X_b)_2D(X_b)_{12}NETX_bTGVX_bS(X_b)_{20}DX_bVSS(X_b)_5F(X_b)_4W(X_b)_2D(X_b)_4GSQKGX_bM(X_b)_3G(X_b)_{38}PX_bTP(X_b)_6G(X_b)_{11}E(X_b)_7RH(X_b)_3A(X_b)_3R(X_b)_5W(X_b)_5A(X_b)_6S(X_b)_8P(X_b)_{20}GX_bG(X_b)_8FRX_bGHX_bG(X_b)_{14}E(X_b)_{12}GX_bG(X_b)_2AA$ (SEQ ID NO: 664), wherein $X_b$ represents independently for each occurrence an amino acid; and wherein the expressed polypeptides having the enzymatic activities (iii) erythro-β-hydroxyaspartate aldolase, (iv) erythro-β-hydroxyaspartate dehydratase, (v) iminosuccinate reductase and (vi) aspartate-glyoxylate transaminase are preferably derived from proteobacteria, more preferably derived from alpha- or gamma-proteobacteria, even more preferably derived from proteobacteria which belong to the genus selected from *Aquisalimonas, Poseidonocella, Marinobacter, Litoreibacter, Thalassobacter, Ruegeria, Paracoccus, Roseobacter, Leisingera, Loktanella, Methylobacterium, Sinorhizobium, Rhizobium, Agrobacter, Cribrihabitans, Dinoroseobacter, Octadecabacter, Planktotalea, Psychrobacter, Yangia, Pseudorhodobacter* or *Neptunomonas*, and particularly preferably derived from *Paracoccus denitrificans*, wherein the autotrophic microorganism belongs to a different species of microorganisms than the microorganism from which the polypeptides are derived.

Preferably, the autotrophic microorganism of the present invention comprises one or more heterologous nucleic acids comprising a polynucleotide sequence of at least 60% sequence identity to SEQ ID NOs: 1, 3, 5, 7, 62 and 64 or SEQ ID NOs: 43-46, 62 and 64. More preferably, the autotrophic microorganism of the present invention comprises one or more nucleic acids comprising a polynucleotide sequence of at least 80% sequence identity to SEQ ID NOs: 1, 3, 5, 7, 62 and 64 or SEQ ID NOs: 43-46, 62 and 64. More preferably, the autotrophic microorganism of the present invention comprises one or more nucleic acids comprising a polynucleotide sequence of at least 90% sequence identity to SEQ ID NOs: 1, 3, 5, 7, 62 and 64 or SEQ ID NOs: 43-46, 62 and 64. More preferably, the autotrophic microorganism of the present invention comprises one or more nucleic acids comprising a polynucleotide sequence of at least 95% sequence identity to SEQ ID NOs: 1, 3, 5, 7, 62 and 64 or SEQ ID NOs: 43-46, 62 and 64. More preferably, the autotrophic microorganism of the present invention comprises one or more nucleic acids comprising a polynucleotide sequence of at least 97% sequence identity to SEQ ID NOs: 1, 3, 5, 7, 62 and 64 or SEQ ID NOs: 43-46, 62 and 64. More preferably, the autotrophic microorganism of the present invention comprises one or more nucleic acids comprising a polynucleotide sequence of at least 98% sequence identity to SEQ ID NOs: 1, 3, 5, 7, 62 and 64 or SEQ ID NOs: 43-46, 62 and 64. More preferably, the autotrophic microorganism of the present invention comprises one or more nucleic acids comprising a polynucleotide sequence of at least 99% sequence identity to SEQ ID NOs: 1, 3, 5, 7, 62 and 64 or SEQ ID NOs: 43-46, 62 and 64. More preferably, the autotrophic microorganism of the present invention comprises one or more nucleic acids comprising a polynucleotide sequence of SEQ ID NOs: 1, 3, 5, 7, 62 and 64 or SEQ ID NOs: 43-46, 62 and 64.

Preferably, the autotrophic microorganism comprises one or more heterologous nucleic acids encoding polypeptides having the enzymatic activities of (i) phosphoglycolate phosphatase, (ii) glyoxylate reductase, (iii) erythro-β-hydroxyaspartate aldolase belonging to the EC class 4.1.3.14, (iv) erythro-β-hydroxyaspartate dehydratase belonging to the EC class 4.3.1.20, (v) iminosuccinate reductase having the conserved amino acid sequence of comprising the conserved amino acid sequence of $GX_aKX_aG(X_a)_8GX_aKX_aGG(X_a)_2PX_aN(X_a)_7NHQS(X_a)_3LF(X_a)_4G(X_a)_8N(X_a)_2TAX_aRTAA\ (X_a)_4S(X_a)_3L(X_a)_8G(X_a)_2GAGX_aQ(X_a)_3Q(X_a)_{15}WN(X_a)_{39}S(X_a)_{15}H(X_a)_3MGTDT(X_a)_2KX_aE(X_a)_{13}D(X_a)_3Q(X_a)_4GEX_aQ(X_a)_{16}G(X_a)_9R(X_a)_6T(X_a)_2DGX_aG(X_a)_3QDX_aA$ (SEQ ID NO: 663), wherein $X_a$ represents independently for each occurrence an amino acid, and (vi) aspartate-glyoxylate transaminase having the conserved amino acid sequence of $W(X_b)_{12}L(X_b)_2D(X_b)_{12}NETX_bTGVX_bS(X_b)_{20}DX_bVSS(X_b)_5F(X_b)_4W(X_b)_2D(X_b)_4GSQKGX_bM(X_b)_3G(X_b)_{38}PX_bTP(X_b)_6G(X_b)_{11}E(X_b)_7RH(X_b)_3A(X_b)_3R(X_b)_5W(X_b)_5A(X_b)_6S(X_b)_8P(X_b)_{20}GX_bG(X_b)_8FRX_bGHX_bG(X_b)_{14}E(X_b)_{12}GX_bG(X_b)_2AA$ (SEQ ID NO: 664), wherein $X_b$ represents independently for each occurrence an amino acid; and wherein the nucleic acids encoding the polypeptides having the enzymatic activities of (i) phosphoglycolate phosphatase, (ii) glyoxylate reductase, (iii) erythro-β-hydroxyaspartate aldolase, (iv) erythro-β-hydroxyaspartate dehydratase, (v) iminosuccinate reductase and (vi) aspartate-glyoxylate transaminase comprise a polynucleotide sequence of at least 80% sequence identity to SEQ ID NOs: 1, 3, 5, 7, 62 and 64 or SEQ ID NOs: 43-46, 62 and 64.

In another embodiment, the autotrophic microorganism comprises one or more heterologous nucleic acids encoding polypeptides having the enzymatic activities of (i) phosphoglycolate phosphatase, (ii) glyoxylate reductase, (iii) erythro-β-hydroxyaspartate aldolase belonging to the EC class 4.1.3.14, (iv) erythro-β-hydroxyaspartate dehydratase belonging to the EC class 4.3.1.20, (v) iminosuccinate reductase having the conserved amino acid sequence of comprising the conserved amino acid sequence of $GX_aKX_aG(X_a)_8GX_aKX_aGG(X_a)_2PX_aN(X_a)_7NHQS(X_a)_3LF(X_a)_4G(X_a)_8N(X_a)_2TAX_aRTAA\ (X_a)_4S(X_a)_3L(X_a)_8G(X_a)_2GAGX_aQ(X_a)_3Q(X_a)_{15}WN(X_a)_{39}S(X_a)_{15}H(X_a)_3MGTDT(X_a)_2KX_aE(X_a)_{13}D(X_a)_3Q(X_a)_4GEX_aQ(X_a)_{16}G(X_a)_9R(X_a)_6T(X_a)_2DGX_aG(X_a)_3QDX_aA$ (SEQ ID NO: 663), wherein $X_a$ represents independently for each occurrence an amino acid, and (vi) aspartate-glyoxylate transaminase having the conserved amino acid sequence of $W(X_b)_{12}L(X_b)_2D(X_b)_{12}NETX_bTGVX_bS(X_b)_{20}DX_bVSS(X_b)_5F(X_b)_4W(X_b)_2D(X_b)_4GSQKGX_bM(X_b)_3G(X_b)_{38}PX_bTP(X_b)_6G(X_b)_{11}E(X_b)_7RH(X_b)_3A(X_b)_3R(X_b)_5W(X_b)_5A(X_b)_6S(X_b)_8P(X_b)_{20}GX_bG(X_b)_8FRX_bGHX_bG(X_b)_{14}E(X_b)_{12}GX_bG(X_b)_2AA$ (SEQ ID NO: 664), wherein $X_b$ represents independently for each occurrence an amino acid; and wherein the nucleic acids encoding the polypeptides having the enzymatic activities of (i) phosphoglycolate phosphatase, (ii) glyoxylate reductase, (iii) erythro-β-hydroxyaspartate aldolase, (iv) erythro-β-hydroxyaspartate dehydratase, (v) iminosuccinate reductase and (vi) aspartate-glyoxylate transaminase comprise a polynucleotide sequence of at least 80% sequence identity to SEQ ID NOs: 1, 3, 5, 7, 62 and 64.

In another embodiment, the autotrophic microorganism comprises one or more heterologous nucleic acids encoding polypeptides having the enzymatic activities of (i) phosphoglycolate phosphatase, (ii) glyoxylate reductase, (iii) erythro-β-hydroxyaspartate aldolase belonging to the EC class 4.1.3.14, (iv) erythro-β-hydroxyaspartate dehydratase belonging to the EC class 4.3.1.20, (v) iminosuccinate reductase having the conserved amino acid sequence of comprising the conserved amino acid sequence of $GX_aKX_aG(X_a)_8GX_aKX_aGG(X_a)_2PX_aN(X_a)_7NHQS(X_a)_3LF(X_a)_4G(X_a)_8N(X_a)_2TAX_aRTAA\ (X_a)_4S(X_a)_3L(X_a)_8G(X_a)_2GAGX_aQ(X_a)_3Q(X_a)_{15}WN(X_a)_{39}S(X_a)_{15}H(X_a)_3MGTDT(X_a)_2KX_aE(X_a)_{13}D(X_a)_3Q(X_a)_4GEX_aQ(X_a)_{16}G(X_a)_9R(X_a)_6T(X_a)_2DGX_aG(X_a)_3QDX_aA$ (SEQ ID NO: 663), wherein $X_a$ represents independently for each occurrence an amino acid, and (vi) aspartate-glyoxylate transaminase having the conserved amino acid sequence of $W(X_b)_{12}L(X_b)_2D(X_b)_{12}NETX_bTGVX_bS(X_b)_{20}DX_bVSS(X_b)_5F(X_b)_4W(X_b)_2D(X_b)_4GSQKGX_bM(X_b)_3G(X_b)_{38}PX_bTP(X_b)_6G(X_b)_{11}E(X_b)_7RH(X_b)_3A(X_b)_3R(X_b)_5W(X_b)_5A(X_b)_6S(X_b)_8P(X_b)_{20}GX_bG(X_b)_8FRX_bGHX_bG(X_b)_{14}E(X_b)_{12}GX_bG(X_b)_2AA$ (SEQ ID NO: 664), wherein $X_b$ represents independently for each occurrence an amino acid; and wherein the nucleic acids encoding the polypeptides having the enzymatic activities of (i) phosphoglycolate phosphatase, (ii) glyoxylate reductase, (iii) erythro-β-hydroxyaspartate aldolase, (iv) erythro-β-hydroxyaspartate dehydratase, (v) iminosuccinate reductase and (vi) aspartate-glyoxylate transaminase comprise a polynucleotide sequence of at least 80% sequence identity to SEQ ID NOs: 43-46, 62 and 64.

In one embodiment, the autotrophic microorganism comprises one or more heterologous nucleic acids encoding polypeptides having the enzymatic activities of (i) phosphoglycolate phosphatase, (ii) glyoxylate reductase, (iii) erythro-β-hydroxyaspartate aldolase belonging to the EC class 4.1.3.14, (iv) erythro-β-25 hydroxyaspartate dehydratase belonging to the EC class 4.3.1.20, (v) iminosuccinate reductase comprising an amino acid sequence of preferably at least 60% sequence identity to a sequence selected from SEQ ID NOs: 2 or 66-363, more preferably at least 80% sequence identity to a sequence selected from SEQ ID NOs: 2 or 66-363, preferably at least 90% sequence identity to a sequence selected from SEQ ID NOs: 2 or 66-363, preferably at least 95% sequence identity to a sequence selected from SEQ ID NOs: 2 or 66-363, preferably at least 97% sequence identity to a sequence selected from SEQ ID NOs: 2 or 66-363, preferably at least 98% sequence identity to a sequence selected from SEQ ID NOs: 2 or 66-363, preferably at least 99% sequence identity to a sequence selected from SEQ ID NOs: 2 or 66-363, preferably at least 100% sequence identity to a sequence selected from SEQ ID NOs: 2 or 66-363, and (vi) aspartate-glyoxylate transaminase having the conserved amino acid sequence of $W(X_b)_{12}L(X_b)_2D(X_b)_{12}NETX_bTGVX_bS(X_b)_{20}DX_bVSS(X_b)_5F(X_b)_4W(X_b)_2D(X_b)_4GSQKGX_bM(X_b)_3G(X_b)_{38}PX_bTP(X_b)_6G(X_b)_{11}E(X_b)_7RH(X_b)_3A(X_b)_3R(X_b)_5W(X_b)_5A(X_b)_6S(X_b)_8P(X_b)_{20}GX_bG(X_b)_8FRX_bGHX_bG(X_b)_{14}E(X_b)_{12}GX_bG(X_b)_2AA$ (SEQ ID NO: 664), wherein $X_b$ represents independently for each occurrence an amino acid.

Preferably, the inventive autotrophic microorganism comprises one or more heterologous nucleic acids, which encode polypeptide having the enzymatic activity of (i) phosphoglycolate phosphatase which comprises an amino acid sequence having at least 80% sequence identity to SEQ ID NO: 63, polypeptide having the enzymatic activity of (ii) glyoxylate reductase which comprises an amino acid sequence having at least 80% sequence identity to SEQ ID NO: 65, polypeptide having the enzymatic activity of (iii) erythro-β-hydroxyaspartate aldolase which comprises an amino acid sequence having at least 80% sequence identity to SEQ ID NO: 4, polypeptide having the enzymatic activity of (iv) erythro-β-hydroxyaspartate dehydratase which comprises an amino acid sequence having at least 80% sequence identity to SEQ ID NO: 6, polypeptide having the enzymatic activity of (v) iminosuccinate reductase which comprises an amino acid sequence having at least 80% sequence identity to a sequence selected from SEQ ID NOs: 2 or 66-363 and polypeptide having the enzymatic activity of (vi) aspartate-glyoxylate transaminase which comprises an amino acid sequence having at least 80% sequence identity to a sequence selected from SEQ ID NOs: 8 or 364-662.

More preferably, the inventive autotrophic microorganism comprises one or more heterologous nucleic acids, which encode polypeptide having the enzymatic activity of (i) phosphoglycolate phosphatase which comprises an amino acid sequence having at least 90% sequence identity to SEQ ID NO: 63, polypeptide having the enzymatic activity of (ii) glyoxylate reductase which comprises an amino acid sequence having at least 90% sequence identity to SEQ ID NO: 65, polypeptide having the enzymatic activity of (iii) erythro-β-hydroxyaspartate aldolase which comprises an amino acid sequence having at least 90% sequence identity to SEQ ID NO: 4, polypeptide having the enzymatic activity of (iv) erythro-β-hydroxyaspartate dehydratase which comprises an amino acid sequence having at least 90% sequence identity to SEQ ID NO: 6, polypeptide having the enzymatic activity of (v) iminosuccinate reductase which comprises an amino acid sequence having at least 90% sequence identity to a sequence selected from SEQ ID NOs: 2 or 66-363 and polypeptide having the enzymatic activity of (vi) aspartate-glyoxylate transaminase which comprises an amino acid sequence having at least 90% sequence identity to a sequence selected from SEQ ID NOs: 8 or 364-662.

More preferably, the inventive autotrophic microorganism comprises one or more heterologous nucleic acids, which encode polypeptide having the enzymatic activity of (i) phosphoglycolate phosphatase comprises an amino acid sequence having at least 95% sequence identity to SEQ ID NO: 63, the de novo expressed polypeptide having the enzymatic activity of (ii) glyoxylate reductase comprises an amino acid sequence having at least 95% sequence identity to SEQ ID NO: 65, the de novo expressed polypeptide having the enzymatic activity of (iii) erythro-β-hydroxyaspartate aldolase comprises an amino acid sequence having at least 95% sequence identity to SEQ ID NO: 4, the de novo expressed polypeptide having the enzymatic activity of (iv) erythro-β-hydroxyaspartate dehydratase comprises an amino acid sequence having at least 95% sequence identity to SEQ ID NO: 6, the de novo expressed polypeptide having the enzymatic activity of (v) iminosuccinate reductase comprises an amino acid sequence having at least 95% sequence identity to a sequence selected from SEQ ID NOs: 2 or 66-363 and the de novo expressed polypeptide having the enzymatic activity of (vi) aspartate-glyoxylate transaminase comprises an amino acid sequence having at least 95% sequence identity to a sequence selected from SEQ ID NOs: 8 or 364-662.

More preferably, the inventive autotrophic microorganism comprises one or more heterologous nucleic acids, which encode polypeptide having the enzymatic activity of (i) phosphoglycolate phosphatase which comprises an amino acid sequence having at least 97% sequence identity to SEQ ID NO: 63, polypeptide having the enzymatic activity of (ii) glyoxylate reductase which comprises an amino acid sequence having at least 97% sequence identity to SEQ ID NO: 65, polypeptide having the enzymatic activity of (iii) erythro-β-hydroxyaspartate aldolase which comprises an amino acid sequence having at least 97% sequence identity to SEQ ID NO: 4, polypeptide having the enzymatic activity of (iv) erythro-β-hydroxyaspartate dehydratase which comprises an amino acid sequence having at least 97% sequence identity to SEQ ID NO: 6, polypeptide having the enzymatic activity of (v) iminosuccinate reductase which comprises an amino acid sequence having at least 97% sequence identity to a sequence selected from SEQ ID NOs: 2 or 66-363 and polypeptide having the enzymatic activity of (vi) aspartate-glyoxylate transaminase which comprises an amino acid sequence having at least 97% sequence identity to a sequence selected from SEQ ID NOs: 8 or 364-662.

More preferably, the inventive autotrophic microorganism comprises one or more heterologous nucleic acids, which encode polypeptide having the enzymatic activity of (i) phosphoglycolate phosphatase which comprises an amino acid sequence having at least 99% sequence identity to SEQ ID NO: 63, polypeptide having the enzymatic activity of (ii) glyoxylate reductase which comprises an amino acid sequence having at least 99% sequence identity to SEQ ID NO: 65, polypeptide having the enzymatic activity of (iii) erythro-β-hydroxyaspartate aldolase which comprises an amino acid sequence having at least 99% sequence identity to SEQ ID NO: 4, polypeptide having the enzymatic activity of (iv) erythro-β-hydroxyaspartate dehydratase which comprises an amino acid sequence having at least 99% sequence identity to SEQ ID NO: 6, polypeptide having the enzymatic activity of (v) iminosuccinate reductase which comprises an amino acid sequence having at least 99% sequence identity to a sequence selected from SEQ ID NOs: 2 or 66-363 and polypeptide having the enzymatic activity of (vi) aspartate-glyoxylate transaminase which comprises an amino acid sequence having at least 99% sequence identity to a sequence selected from SEQ ID NOs: 8 or 364-662.

More preferably, the inventive autotrophic microorganism comprises one or more heterologous nucleic acids, which encode polypeptide having the enzymatic activity of (i) phosphoglycolate phosphatase which comprises an amino acid sequence of SEQ ID NO: 63, polypeptide having the enzymatic activity of (ii) glyoxylate reductase which comprises an amino acid sequence of SEQ ID NO: 65, polypeptide having the enzymatic activity of (iii) erythro-β-hydroxyaspartate aldolase which comprises an amino acid sequence of SEQ ID NO: 4, polypeptide having the enzymatic activity of (iv) erythro-β-hydroxyaspartate dehydratase which comprises an amino acid sequence of SEQ ID NO: 6, polypeptide having the enzymatic activity of (v) iminosuccinate reductase which comprises an amino acid sequence selected from SEQ ID NOs: 2 or 66-363 and polypeptide having the enzymatic activity of (vi) aspartate-glyoxylate transaminase which comprises an amino acid sequence selected from SEQ ID NOs: 8 or 364-662.

In another embodiment, the inventive autotrophic microorganism comprises one or more heterologous nucleic acids, which encode polypeptide having the enzymatic activity of (i) phosphoglycolate phosphatase which comprises an amino acid sequence having at least 80% sequence identity to SEQ ID NO: 63, polypeptide having the enzymatic activity of (ii) glyoxylate reductase which comprises an amino acid sequence having at least 80% sequence identity to SEQ ID NO: 65, polypeptide having the enzymatic activity of (iii) erythro-β-hydroxyaspartate aldolase which comprises an amino acid sequence having at least 80% sequence identity to SEQ ID NO: 4, polypeptide having the enzymatic activity of (iv) erythro-β-hydroxyaspartate dehydratase which comprises an amino acid sequence having at least 80% sequence identity to SEQ ID NO: 6, polypeptide having the enzymatic activity of (v) iminosuccinate reductase which comprises an amino acid sequence having at least 80% sequence identity to SEQ ID NO: 2 and polypeptide having the enzymatic activity of (vi) aspartate-glyoxylate transaminase which comprises an amino acid sequence having at least 80% sequence identity to SEQ ID NOs: 8.

In one embodiment, the autotrophic microorganism comprises one or more heterologous nucleic acids encoding polypeptides having the enzymatic activities of (i) phosphoglycolate phosphatase, (ii) glyoxylate reductase, (iii) erythro-β-hydroxyaspartate aldolase belonging to the EC class 4.1.3.14, (iv) erythro-β-hydroxyaspartate dehydratase belonging to the EC class 4.3.1.20, (v) iminosuccinate reductase having the conserved amino acid sequence of comprising the conserved amino acid sequence of $GX_aKX_aG(X_a)_8GX_aKX_aGG(X_a)_2PX_aN(X_a)_7NHQS(X_a)_3LF(X_a)_4G(X_a)_8N(X_a)_2TAX_aRTAA$ $(X_a)_4S(X_a)_3L(X_a)_8G(X_a)_2GAGX_aQ(X_a)_3Q(X_a)_{15}WN(X_a)_{39}S(X_a)_{15}H(X_a)_3MGTDT(X_a)_2KX_aE(X_a)_{13}D(X_a)_3Q(X_a)_4GEX_aQ(X_a)_{16}G(X_a)_9R(X_a)_6T(X_a)_2DGX_aG(X_a)_3QDX_aA$ (SEQ ID NO: 663), wherein $X_a$ represents independently for each occurrence an amino acid, and (vi) aspartate-glyoxylate transaminase having the conserved amino acid sequence of $X^4X^7X_cX^6X_cX^9X^4X_cX_cX_cX^4X_cX_cX_cWX^9X_cX^7X^4X^7X_c\text{-}X_cX_cX^4X^9X^9X_cLX_cX_cDX_cX_cX_cX^4X^5X^5X^2X^4X^7X^7X^5\text{-}NETX^8TGVX_cSX^5X^2X^9X_cX^4X^9X^9X_cX^4X_cX_cX_cX^5X_c\text{-}X^8X^4X^4X^4X^2DX^7VSSX^2X^8X^7X^4X_cFX^9X_cX^9X^9WX_cX^2\text{-}DX^4X^7X^2X^7GSQKGX^4MX^4X_cX^7GX^4X^7X^4X^4X^7X^4X^8X_c\text{-}X^4X^8X_cX_cX_cX_cX^7X_cX^4X_cX^5X^4X^3X^4X^9X^4X^9X^9X_c\text{-}X_cX_cX_cX_cX_cX_cX_cX^4PX_cTPXA_cX^9X^4X^4X_cGX^4X_cX_c\text{-}X^7X_cX^9X_cX^4X_cX_cX^9EX^9X^4X_cX^9X^2X^4X^9RHX_cX^4X^4A\text{-}X^9X^8X^4RX_cX^8X^4X_cX^8WX^9X^4X_cX_cX^4AX_cX^9X_cX^9X_c\text{-}SX_cX^1X^2X^1X^7X^2X_cX^4PX_cX^9X^4X^5X^8X_cX_cX^4X^4X^9X_cX^7\text{-}X_cX_cX_cX^3X^9X^4X^8X^4GX_cGX_4X_cX_cX^4X_cX^7X^5X^4FRX^2GH\text{-}X^2GX_cX^4X^7X_cX_cX_cX^4X_cX_cX^8X^2X^7X_cX^4EX^4X^7X^4X^4X^9\text{-}X_cX^9X^4X_cX^4X_cX_cGX_cGX^7X_cAAX_cX^9X_cX^4$ (SEQ ID NO 665), wherein $X_c$ represents independently for each occurrence an amino acid;

$X^1$ represents independently for each occurrence S or T, $X^2$ represents independently for each occurrence I, L or V, $X^3$ represents independently for each occurrence F, H, W or Y, $X^4$ represents independently for each occurrence A, C, F, G, H, I, K, L, M, R, T, V, W or Y, $X^5$ represents independently for each occurrence C, D, E, H, K, N, Q, R, S or T, $X^6$ represents independently for each occurrence H, K or R, $X^7$ represents independently for each occurrence A, C, D, G, N, P, S, T or V, $X^8$ represents independently for each occurrence A, G or S, $X^9$ represents independently for each occurrence A, C, D, E, G, H, K, N, Q, R, S or T.

In another embodiment, the autotrophic microorganism comprises one or more heterologous nucleic acids encoding polypeptides having the enzymatic activities of (i) phosphoglycolate phosphatase, (ii) glyoxylate reductase, (iii) erythro-β-hydroxyaspartate aldolase belonging to the EC class 4.1.3.14, (iv) erythro-β-hydroxyaspartate dehydratase belonging to the EC class 4.3.1.20, (v) iminosuccinate reductase having the conserved amino acid sequence of comprising the conserved amino acid sequence of $GX_aKX_aG(X_a)_8GX_aKX_aGG(X_a)_2PX_aN(X_a)_7NHQS(X_a)_3LF(X_a)_4G(X_a)_8N(X_a)_2TAX_aRTAA$ $(X_a)_4S(X_a)_3L(X_a)_8G(X_a)_2GAGX_aQ(X_a)_3Q(X_a)_{15}WN(X_a)_{39}S(X_a)_{15}H(X_a)_3MGTDT(X_a)_2KX_aE(X_a)_{13}D(X_a)_3Q(X_a)_4GEX_aQ(X_a)_{16}G(X_a)_9R(X_a)_6T(X_a)_2DGX_aG(X_a)_3QDX_aA$ (SEQ ID NO: 663), wherein $X_a$ represents independently for each occurrence an amino acid, and the polypeptide having the enzymatic activity of (vi) aspartate-glyoxylate transaminase comprises an amino acid sequence of at least 80% sequence identity to a sequence selected from SEQ ID NOs: 8, or 364-662.

Preferably, the autotrophic microorganism according to the present invention is selected from microalgae, eukaryotic microorganisms, prokaryotic microorganisms, bacteria, including cyanobacteria, proteobacteria, purple bacteria, green sulfur bacteria, halophiles or methanogens. Preferably the autotrophic microorganism is a cyanobacterium. Preferably, the autotrophic microorganism according to the present invention is selected from *Arthrospira platensis*, *Arthrospira maxima*, *Chlorella vulgaris*, *Dunaliella tertiolecta*, *Dunaliella salina*, *Tetraselmis maculata*, *Euglena gracilis*, *Scenedesmus obliquus*, *Cupriavidus necator*, *Chlamydomonas reinhardtii*, *Thalassiosira pseudonana*, *Nannochloropsis oculata*, *Skeletonema marinoi* and *Chaetoceros muelleri*.

The skilled person in the art may readily envision, that the expression of a (i) phosphoglycolate phosphatase is not required for all autotrophic microorganisms in order to bypass the photorespiration pathway since some autotrophic microorganism naturally express a phosphoglycolate phosphatase capable of hydrolyzing 2-phosphoglycolate. Thus, in one embodiment of the present invention, the autotrophic microorganism comprises one or more heterologous nucleic acids encoding polypeptides having the enzymatic activities of (ii) glyoxylate reductase, (iii) erythro-β-hydroxyaspartate aldolase belonging to the EC class 4.1.3.14, (iv) erythro-β-hydroxyaspartate dehydratase belonging to the EC class 4.3.1.20, (v) iminosuccinate reductase having the conserved amino acid sequence of comprising the conserved amino acid sequence of $GX_aKX_aG(X_a)_8GX_aKX_aGG(X_a)_2PX_aN(X_a)_7NHQS(X_a)_3LF(X_a)_4G(X_a)_8N(X_a)_2TAX_aRTAA(X_a)_4S(X_a)_3L(X_a)_8G(X_a)_2GAGX_aQ(X_a)_3Q(X_a)_{15}WN(X_a)_{39}S(X_a)_{15}H(X_a)_3MGTDT(X_a)_2KX_aE(X_a)_{13}D(X_a)_3Q(X_a)_4GEX_aQ(X_a)_{16}G(X_a)_9R(X_a)_6T(X_a)_2DGX_aG(X_a)_3QDX_aA$ (SEQ ID NO: 663), wherein $X_a$ represents independently for each occurrence an amino acid, and (vi) aspartate-glyoxylate transaminase having the conserved amino acid sequence of $W(X_b)_{12}L(X_b)_2D(X_b)_{12}NETX_bTGVX_bS(X_b)_{20}DX_bVSS(X_b)_5F(X_b)_4W(X_b)_2D(X_b)_4GSQKGX_bM(X_b)_3G(X_b)_{38}PX_bTP(X_b)_6G(X_b)_{11}E(X_b)_7RH(X_b)_3A(X_b)_3R(X_b)_5W(X_b)_5A(X_b)_6S(X_b)_8P(X_b)_{20}GX_bG(X_b)_8FRX_bGHX_bG(X_b)_{14}\text{-}E(X_b)_{12}GX_bG(X_b)_2AA$ (SEQ ID NO: 664), wherein $X_b$ represents independently for each occurrence an amino acid.

Moreover, the skilled person in the art may readily envision, that the enzymes glycolate oxidase (GO; EC 1.1.3.15) and glycolate dehydrogenase (GDH; EC 1.1.99.14) are capable of oxidizing glycolate to glyoxylate, thereby can replace the (ii) glyoxylate reductase. In case glycolate oxidase is used, a catalase enzyme (CAT; EC 1.11.1.7) must be expressed, too, in order to convert the toxic hydrogen peroxide. Thus, in one embodiment of the present invention, the autotrophic microorganism comprises one or more heterologous nucleic acids encoding polypeptides having the enzymatic activities of (ii') glycolate oxidase and catalase, glyoxylate reductase or glycolate dehydrogenase, (iii) erythro-β-hydroxyaspartate aldolase belonging to the EC class 4.1.3.14, (iv) erythro-β-hydroxyaspartate dehydratase belonging to the EC class 4.3.1.20, (v) iminosuccinate reductase having the conserved amino acid sequence of comprising the conserved amino acid sequence of $GX_aKX_aG(X_a)_8GX_aKX_aGG(X_a)_2PX_aN(X_a)_7NHQS(X_a)_3LF(X_a)_4G(X_a)_8N(X_a)_2TAX_aRTAA(X_a)_4S(X_a)_3L(X_a)_8G(X_a)_2GAGX_aQ(X_a)_3Q(X_a)_{15}WN(X_a)_{39}\text{-}S(X_a)_{15}H(X_a)_3MGTDT(X_a)_2KX_aE(X_a)_{13}D(X_a)_3Q(X_a)_4GEX_aQ(X_a)_{16}G(X_a)_9R(X_a)_6T(X_a)_2DGX_aG(X_a)_3QDX_aA$ (SEQ ID NO: 663), wherein $X_a$ represents independently for each occurrence an amino acid, and (vi) aspartate-glyoxylate transaminase having the conserved amino acid sequence of $W(X_b)_{12}L(X_b)_2D(X_b)_{12}NETX_bTGVX_bS(X_b)_{20}DX_bVSS(X_b)_5F(X_b)_4W(X_b)_2D(X_b)_4GSQKGX_bM(X_b)_3G(X_b)_{38}PX_bTP(X_b)_6G(X_b)_{11}E(X_b)_7RH(X_b)_3A(X_b)_3R(X_b)_5W(X_b)_5A(X_b)_6S(X_b)_8P(X_b)_{20}GX_bG(X_b)_8FRX_bGHX_bG(X_b)_{14}E(X_b)_{12}GX_bG(X_b)_2AA$ (SEQ ID NO: 664), wherein $X_b$ represents independently for each occurrence an amino acid.

In one embodiment of the present invention, the autotrophic microorganism comprises one or more heterologous nucleic acids encoding polypeptides having the enzymatic activities of (i) phosphoglycolate phosphatase, (ii') glycolate oxidase and catalase, glyoxylate reductase or glycolate dehydrogenase, (iii) erythro-β-hydroxyaspartate aldolase belonging to the EC class 4.1.3.14, (iv) erythro-β-hydroxyaspartate dehydratase belonging to the EC class 4.3.1.20, (v) iminosuccinate reductase having the conserved amino acid sequence of comprising the conserved amino acid sequence of $GX_aKX_aG(X_a)_8GX_aKX_aGG(X_a)_2PX_aN(X_a)_7NHQS(X_a)_3LF(X_a)_4G(X_a)_8N(X_a)_2TAX_aRTAA(X_a)_4S(X_a)_3L(X_a)_8G(X_a)_2GAGX_aQ(X_a)_3Q(X_a)_{15}WN(X_a)_{39}$-$S(X_a)_{15}H(X_a)_3MGTDT(X_a)_2KX_aE(X_a)_{13}D(X_a)_3Q(X_a)_4GEX_aQ(X_a)_{16}G(X_a)_9R(X_a)_6T(X_a)_2DGX_aG(X_a)_3QDX_aA$ (SEQ ID NO: 663), wherein $X_a$ represents independently for each occurrence an amino acid, and (vi) aspartate-glyoxylate transaminase having the conserved amino acid sequence of $W(X_b)_{12}L(X_b)_2D(X_b)_{12}NETX_bTGVX_bS(X_b)_{20}DX_bVSS(X_b)_5F(X_b)_4W(X_b)_2D(X_b)_4GSQKGX_bM(X_b)_3$-$G(X_b)_{38}PX_bTP(X_b)_6G(X_b)_{11}E(X_b)_7RH(X_b)_3A(X_b)_3R(X_b)_5W(X_b)_5A(X_b)_6S(X_b)_8P(X_b)_{20}GX_bG(X_b)_8FRX_bGHX_b$-$G(X_b)_{14}E(X_b)_{12}GX_bG(X_b)_2AA$ (SEQ ID NO: 664), wherein $X_b$ represents independently for each occurrence an amino acid.

In one embodiment, the autotrophic microorganism comprises one or more heterologous nucleic acids encoding polypeptides having the enzymatic activities of (i) phosphoglycolate phosphatase, (ii) glyoxylate reductase, (iii) erythro-β-hydroxyaspartate aldolase belonging to the EC class 4.1.3.14, (iv) erythro-β-hydroxyaspartate dehydratase belonging to the EC class 4.3.1.20, (v) iminosuccinate reductase having the conserved amino acid sequence of comprising the conserved amino acid sequence of $GX_aKX_aG(X_a)_8GX_aKX_aGG(X_a)_2PX_aN(X_a)_7NHQS(X_a)_3LF(X_a)_4G(X_a)_8N(X_a)_2TAX_aRTAA$ $(X_a)_4S(X_a)_3L(X_a)_8G(X_a)_2GAGX_aQ(X_a)_3Q(X_a)_{15}WN(X_a)_{39}S(X_a)_{15}H(X_a)_3MGTDT(X_a)_2KX_aE(X_a)_{13}D(X_a)_3Q(X_a)_4GEX_aQ(X_a)_{16}G(X_a)_9R(X_a)_6T(X_a)_2DGX_aG(X_a)_3QDX_aA$ (SEQ ID NO: 663), wherein $X_a$ represents independently for each occurrence an amino acid, (vi) aspartate-glyoxylate transaminase having the conserved amino acid sequence of $W(X_b)_{12}L(X_b)_2D(X_b)_{12}NETX_bTGVX_bS(X_b)_{20}DX_bVSS(X_b)_5F(X_b)_4W(X_b)_2D(X_b)_4GSQKGX_bM(X_b)_3G(X_b)_{38}PX_bTP(X_b)_6G(X_b)_{11}E(X_b)_7RH(X_b)_3A(X_b)_3R(X_b)_5W(X_b)_5A(X_b)_6S(X_b)_8P(X_b)_{20}GX_bG(X_b)_8FRX_bGHX_bG(X_b)_{14}E(X_b)_{12}GX_bG(X_b)_2$ AA (SEQ ID NO: 664), wherein $X_b$ represents independently for each occurrence an amino acid, and (vii) β-hydroxyaspartate regulatory protein. Preferably the polypeptide having the enzymatic activity of (vii) (β-hydroxyaspartate regulatory protein comprises the conserved amino acid sequence of $ET(X_d)_{23}R(X_d)_5G(X_d)_{10}G$ (SEQ ID NO: 965), wherein $X_d$ represents independently for each occurrence an amino acid. More preferably, the polypeptide having the enzymatic activity of (vii) β-hydroxyaspartate regulatory protein comprises an amino acid sequence having at least 80% sequence identity to a sequence selected from SEQ ID NOs: 10 and 666-964. More preferably, the polypeptide having the enzymatic activity of (vii) β-hydroxyaspartate regulatory protein comprises an amino acid sequence having at least 80% sequence identity to SEQ ID NO: 10. More preferably, the polypeptide having the enzymatic activity of (vii) β-hydroxyaspartate regulatory protein comprises an amino acid sequence selected from SEQ ID NOs: 10 and 666-964. More preferably, the polypeptide having the enzymatic activity of (vii) β-hydroxyaspartate regulatory protein comprises an amino acid sequence of SEQ ID NO: 10.

Preferably, the inventive autotrophic microorganism comprises one or more heterologous nucleic acids, which encode polypeptide having the enzymatic activity of (i) phosphoglycolate phosphatase which comprises an amino acid sequence having at least 80% sequence identity to SEQ ID NO: 63, polypeptide having the enzymatic activity of (ii) glyoxylate reductase which comprises an amino acid sequence having at least 80% sequence identity to SEQ ID NO: 65, polypeptide having the enzymatic activity of (iii) erythro-β-hydroxyaspartate aldolase which comprises an amino acid sequence having at least 80% sequence identity to SEQ ID NO: 4, polypeptide having the enzymatic activity of (iv) erythro-β-hydroxyaspartate dehydratase which comprises an amino acid sequence having at least 80% sequence identity to SEQ ID NO: 6, polypeptide having the enzymatic activity of (v) iminosuccinate reductase which comprises an amino acid sequence having at least 80% sequence identity to a sequence selected from SEQ ID NOs: 2 or 66-363, polypeptide having the enzymatic activity of (vi) aspartate-glyoxylate transaminase which comprises an amino acid sequence having at least 80% sequence identity to a sequence selected from SEQ ID NOs: 8 or 364-662, and polypeptide having the enzymatic activity of (vii) β-hydroxyaspartate regulatory protein which comprises an amino acid sequence having at least 80% sequence identity to SEQ ID NO: 10.

Preferably, the inventive autotrophic microorganism comprises one or more heterologous nucleic acids, which encode polypeptide having the enzymatic activity of (i) phosphoglycolate phosphatase which comprises an amino acid sequence having at least 80% sequence identity to SEQ ID NO: 63, polypeptide having the enzymatic activity of (ii) glyoxylate reductase which comprises an amino acid sequence having at least 80% sequence identity to SEQ ID NO: 65, polypeptide having the enzymatic activity of (iii) erythro-β-hydroxyaspartate aldolase which comprises an amino acid sequence having at least 80% sequence identity to SEQ ID NO: 4, polypeptide having the enzymatic activity of (iv) erythro-β-hydroxyaspartate dehydratase which comprises an amino acid sequence having at least 80% sequence identity to SEQ ID NO: 6, polypeptide having the enzymatic activity of (v) iminosuccinate reductase which comprises an amino acid sequence having at least 80% sequence identity to SEQ ID NO: 2, polypeptide having the enzymatic activity of (vi) aspartate-glyoxylate transaminase which comprises an amino acid sequence having at least 80% sequence identity to SEQ ID NO: 8, and polypeptide having the enzymatic activity of (vii) β-hydroxyaspartate regulatory protein which comprises an amino acid sequence having at least 80% sequence identity to SEQ ID NO: 10.

The inventive one or more nucleic acids encoding polypeptides having the enzymatic activities of (i) phosphoglycolate phosphatase, (ii) glyoxylate reductase, (iii) erythro-β-hydroxyaspartate aldolase, (iv) erythro-β-hydroxyaspartate dehydratase, (v) iminosuccinate reductase and (vi) aspartate-glyoxylate transaminase, may be introduced into an autotrophic microorganism by any conventional method known in the art, including, but not limited to, transformation of cells which are naturally competent, chemically competent, or electrocompetent, conjugation of cells using one or more helper strains, biolistic particle delivery with a DNA payload using a suitable instrument, transfection, *Agrobacterium tumefaciens*-mediated transformation, protoplast transformation, or any method involving the CRISPR/Cas9 system or a similar DNA-editing system.

For the purpose of expressing the nucleic acid(s) which encode(s) the polypeptides having the enzymatic activities as required for the present invention in autotrophic microorganisms any convenient regulatory sequences can be used. The regulatory sequences will provide transcriptional and translational initiation as well as termination regions, where the transcriptional initiation may be constitutive or inducible. The coding region is operably linked to such regulatory sequences.

Generally, the nucleic acid(s) (e.g. a recombinant DNA construct) which encode(s) (an) enzyme(s) to be expressed in accordance with the invention may include a promoter operably linked to the transcribable nucleotide sequence. In various embodiments, the promoter may be selected from the group consisting of a constitutive promoter, a spatially specific promoter, a temporally specific promoter, a developmentally specific promoter, and an inducible promoter. Non-constitutive promoters suitable for use with the nucleotide sequence to be employed (e.g. recombinant DNA construct) of the invention include spatially specific promoters, temporally specific promoters, and inducible promoters. Spatially specific promoters can include cell-, tissue-, or organ-specific promoters. Temporally specific promoters can include promoters that tend to promote expression during certain developmental stages in an organism's (e.g. plant's) growth cycle or during different times of day or night, or at different seasons in a year. Inducible promoters include promoters induced by chemicals or by environmental conditions such as, but not limited to, biotic or abiotic stress (e. g., water deficit or drought, heat, cold, high or low nutrient or salt levels, high or low light levels, or pest or pathogen infection). An expression-specific promoter can also include promoters that are generally constitutively expressed but at differing degrees or "strengths" of expression, including promoters commonly regarded as "strong promoters" or as "weak promoters".

DESCRIPTION OF THE FIGURES

FIGS. 12A-12CC: shows the nucleotide and amino acid sequences of the enzymes of the BHA pathway.

Figure 1:
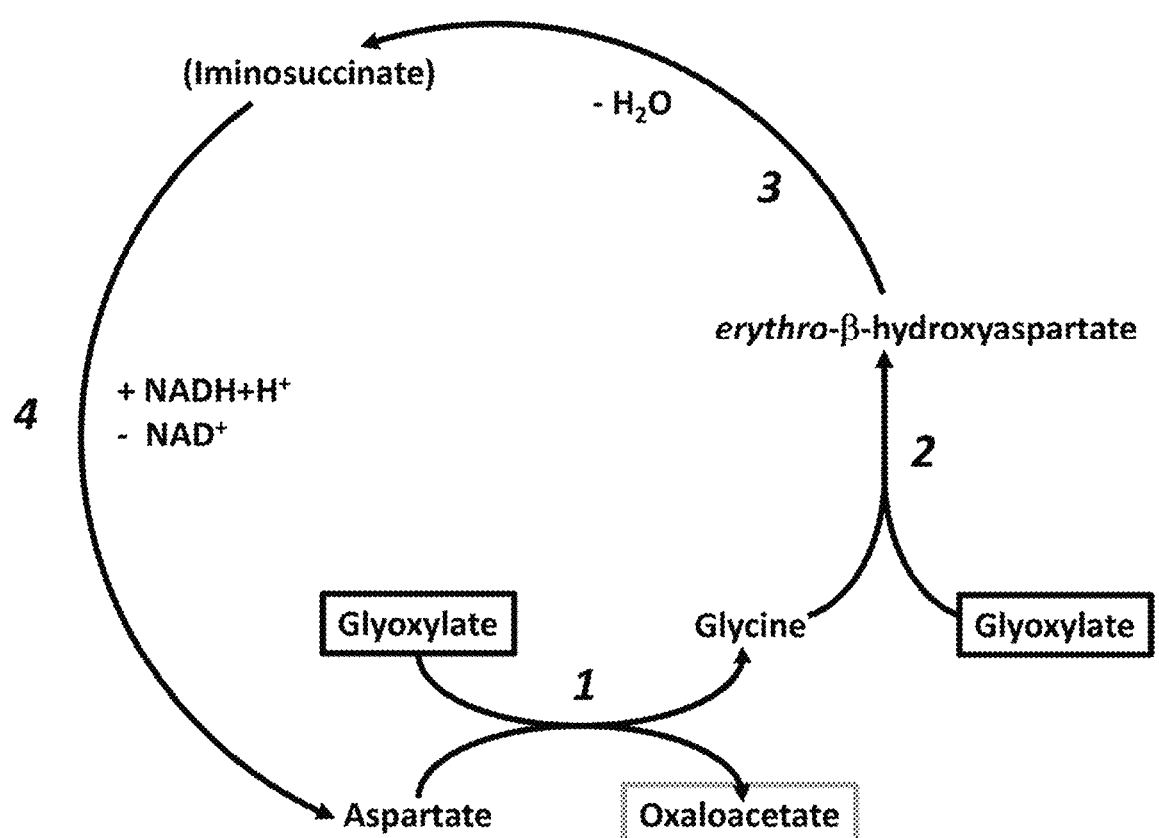
FIG. 1: illustrates the reaction sequence of the β-hydroxyaspartate pathway (BHAP) in *Paracoccus denitrificans* for the conversion of glyoxylate via the unstable iminosuccinate (shown in brackets) into oxaloacetate. The italic numbers represent the enzyme catalyzing the respective reaction: 1: aspartate-glyoxylate transaminase; 2: erythro-β-hydroxyaspartate aldolase (BHAA); 3: erythro-β-hydroxyaspartate dehydratase (BHAD) and 4: iminosuccinate reductase (ISRed). The net equation of the pathway is shown below the scheme.
Figure 1:
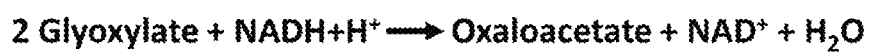

The following examples are included to demonstrate preferred embodiments of the invention. It should be appreciated by those skilled in the art that the techniques disclosed in the examples, which follow represent techniques discovered by the inventor to function well in the practice of the invention, and thus can be considered to constitute preferred modes for its practice. However, those skilled in the art should, in light of the present disclosure, appreciate that many changes can be made in the specific embodiments, which are disclosed and still obtain a like or similar result without departing from the spirit and scope of the invention.

Further modifications and alternative embodiments of various aspects of the invention will be apparent to those skilled in the art in view of this description. Accordingly, this description is to be construed as illustrative only and is for the purpose of teaching those skilled in the art the general manner of carrying out the invention. It is to be understood that the forms of the invention shown and described herein are to be taken as examples of embodiments. Elements and materials may be substituted for those illustrated and described herein, parts and processes may be reversed, and certain features of the invention may be utilized independently, all as would be apparent to one skilled in the art after having the benefit of this description of the invention. Changes may be made in the elements described herein without departing from the spirit and scope of the invention as described in the following claims.

EXAMPLES

Abbreviations and Acronyms
AGAT aspartate glyoxylate aminotransferase
IRed imine reductase
ISRed iminosuccinate reductase
BHA erythro-β-hydroxyaspartate
BHAA β-hydroxyaspartate aldolase
BHAD β-hydroxyaspartate dehydratase
BHAP β-hydroxyaspartate pathway
Calvin-Benson-Bassham CBB
DNA desoxyribo nucleic acid
FDH formate dehydrogenase
MDH malate dehydrogenase Chemicals & Reagents
Unless otherwise stated, all chemicals and reagents were acquired from Sigma-Aldrich, and were of the highest purity available.

Methods

Construction of Expression Vectors for Heterologous Expression of the Enzymes ISRed, BHAA, BHAD and AGAT as Well as the Regulatory Protein BHAR The gene encoding for the iminosuccinate reductase enzyme from *Paracoccus denitrificans* DSM 413 (ISRed; nucleic acid sequence shown in SEQ ID NO: 1; amino acid sequence shown in SEQ ID NO: 2) was cloned into the standard expression vector pET16b (commercially available from Merck Millipore). To this end, the ISRed gene was amplified from genomic DNA of *Paracoccus denitrificans* DSM 413 with the primers

```
                                    (SEQ ID NO: 11)
5'-GACGCCTCATATGCTCGTCGTCGCCGAAAAG-3'

(SEQ ID NO: 12)
5'-GCCACTCCTCGAGTCAGATCTCGACCTCTTG-3'
```

The resulting PCR product was digested with the endonucleases NdeI and XhoI and ligated into the expression vector pET16b to create a vector for heterologous expression of ISRed.

The gene encoding for the β-hydroxyaspartate aldolase enzyme from *Paracoccus denitrificans* DSM 413 (BHAA; nucleic acid sequence shown in SEQ ID NO: 3; amino acid sequence shown in SEQ ID NO: 4) was cloned into the standard expression vector pET16b (commercially available from Merck Millipore). To this end, the BHAA gene was amplified from genomic DNA of *Paracoccus denitrificans* DSM 413 with the primers

```
                                    (SEQ ID NO: 13)
5'-GACGCCGCATATGAACGCGAAAACGGATTTC-3'

(SEQ ID NO: 14)
5'-GACACCTGGATCCTCAGTAGCCCTTTCCG-3'
```

The resulting PCR product was digested with the endonucleases NdeI and BamHI and ligated into the expression vector pET16b to create a vector for heterologous expression of BHAA.

The gene encoding for the β-hydroxyaspartate dehydratase enzyme from *Paracoccus denitrificans* DSM 413 (BHAD; nucleic acid sequence shown in SEQ ID NO: 5; amino acid sequence shown in SEQ ID NO: 6) was cloned into the standard expression vector pET16b (commercially available from Merck Millipore). To this end, the BHAD gene was amplified from genomic DNA of *Paracoccus denitrificans* DSM 413 with the primers

```
                                    (SEQ ID NO: 15)
5'-GACGCTGCATATGTATATCCCGACCTATGAG-3'

(SEQ ID NO: 16)
5'-GACACTCGGATCCTCAGTTCCACGGCAGCTTG-3'
```

The resulting PCR product was digested with the endonucleases NdeI and BamHI and ligated into the expression vector pET16b to create a vector for heterologous expression of BHAD.

The gene encoding for the aspartate-glyoxylate aminotransferase enzyme from *Paracoccus denitrificans* DSM 413 (AGAT; nucleic acid sequence shown in SEQ ID NO: 7; amino acid sequence shown in SEQ ID NO: 8) was cloned into the standard expression vector pET16b (commercially available from Merck Millipore). To this end, the AGAT gene was amplified from genomic DNA of *Paracoccus denitrificans* DSM 413 with the primers

5'-GCCACTACATATGACCAGCCAGAACCC-3' (SEQ ID NO: 17)

5'-GCCACTCGGATCCTCAGGCGGCTTTCTTCTGC-3' (SEQ ID NO: 18)

The resulting PCR product was digested with the endonucleases NdeI and BamHI and ligated into the expression vector pET16b to create a vector for heterologous expression of AGAT.

The gene encoding for the BHA-regulatory protein from *Paracoccus denitrificans* DSM 413 (BHAR; nucleic acid sequence shown in SEQ ID NO: 9; amino acid sequence shown in SEQ ID NO: 10) was cloned into the standard expression vector pET16b (commercially available from Merck Millipore). To this end, the BHAR gene was amplified from genomic DNA of *Paracoccus denitrificans* DSM 413 with the primers

5'-GCCACATCATATGTCGGTTCAAATCC-3' (SEQ ID NO: 19)

5'-GTCACTCGGATCCTCAGGCTCTTTCGCCGGCATC-3' (SEQ ID NO: 20)

The resulting PCR product was digested with the endonucleases NdeI and BamHI and ligated into the expression vector pET16b to create a vector for heterologous expression of BHAR.

Heterologous Expression and Purification of Recombinant Proteins

Enzymes of the BHAP

For heterologous overexpression of the AGAT, BHAD, BHAA and ISRed enzymes, respectively, the corresponding plasmid encoding the respective enzyme was first transformed into chemically competent *E. coil* BL21 Al cells. The cells were then grown on LB agar plates containing 100 μg mL$^{-1}$ ampicillin at 37° C. overnight. A starter culture in selective LB medium was inoculated from a single colony on the next day and left to grow overnight at 37° C. in a shaking incubator. The starter culture was used on the next day to inoculate an expression culture in selective TB medium in a 1:100 dilution. The expression culture was grown at 37° C. in a shaking incubator to an OD$_{600}$ of 0.5 to 0.7, induced with 0.5 mM IPTG and 0.2% L-arabinose and subsequently grown overnight at 18° C. in a shaking incubator.

Cells were harvested at 6,000× g for 15 min at 4° C. and cell pellets were stored at −20° C. until purification of enzymes. Cell pellets were resuspended in twice their volume of buffer A (300 mM NaCl, 25 mM Tris-HCl pH 8.0, 15 mM imidazole, 1 mM β-mercaptoethanol, 0.1 mM MgCl$_2$, 0.01 mM pyridoxalphosphate (PLP), and one tablet of SIGMAFAST™ protease inhibitor cocktail, EDTA-free per L). The cell suspension was treated with a Sonopuls GM200 sonicator (BANDELIN Electronic GmbH & Co. KG, Berlin, Germany) at an amplitude of 50% in order to lyse the cells and subsequently centrifuged at 50,000× g and 4° C. for 1 h. The filtered supernatant (0.45 μm filter, Sarstedt, Numbrecht, Germany) was loaded onto Protino® Ni-NTA Agarose (Macherey-Nagel, Duren, Germany) in a gravity column, which had previously been equilibrated with 5 column volumes of buffer A. The column was washed with column volumes of buffer A and 5 column volumes of 85% buffer A and 15% buffer B and the His-tagged protein was eluted with buffer B (buffer A with 500 mM imidazole). The eluate was desalted using PD-10 desalting columns (GE Healthcare, Chicago, USA) and buffer C (100 mM NaCl, 25 mM Tris-HCl pH 8.0, 1 mM MgCl$_2$, 0.01 mM PLP, 0.1 mM dithiothreitol (DTT)). This was followed by purification on a size exclusion column (Superdex™ 200 μg, HiLoad™ 16/600; GE Healthcare, Chicago, USA) connected to an ÄKTA Pure system (GE Healthcare, Chicago, USA) using buffer C. 2 mL concentrated protein solution was injected, and flow was kept constant at 1 mL min$^-$. Elution fractions containing pure protein were determined via SDS-PAGE analysis (Laemmli 1970) on 12.5% gels. Purified enzymes in buffer C were used for crystallization or stored at −20° C. in buffer C containing 50% glycerol for later use in enzymatic assays. BhcR was expressed and purified in the same way, except that buffer A contained 100 mM KCl, 20 mM HEPES-KOH pH 7.5, 10 mM MgCl$_2$, 4 mM β-mercaptoethanol, 5% glycerol and one tablet of SIGMAFAST™ protease inhibitor cocktail, EDTA-free per L. Buffer C contained 100 mM KCl, 20 mM HEPES-KOH pH 7.5, 10 mM MgCl$_2$, 5% glycerol and 1 mM DTT. NADH-dependent malate dehydrogenase (Mdh) and NADPH-dependent glyoxylate reductase (GhrA) from *E. coil* were overexpressed using the respective strains from the ASKA collection (Kitagawa, Ara et al. 2005). A starter culture in selective LB medium (34 μg mL$^{-1}$ chloramphenicol) was inoculated from a single colony and left to grow overnight at 37° C. in a shaking incubator. The starter culture was used on the next day to inoculate an expression culture in selective TB medium in a 1:100 dilution. The expression culture was grown at 37° C. in a shaking incubator to an OD$_{600}$ of 0.6, induced with 0.5 mM IPTG and grown for four more hours at 37° C. in a shaking incubator. The enzymes were affinity-purified in the same way as described above, except that buffer A contained 200 mM NaCl, 50 mM potassium phosphate pH 7.0, 15 mM imidazole, 1 mM β-mercaptoethanol, and one tablet of SIGMAFAST™ protease inhibitor cocktail, EDTA-free per L. Buffer C contained 100 mM NaCl, 50 mM potassium phosphate pH 7.0, and 0.1 mM DTT. The purified enzyme was stored at −20° C. in buffer C containing 50% glycerol.

Malate Dehydrogenase

The NADH-dependent malate dehydrogenase from *E. coli* (henceforth MDH enzyme) was overexpressed using the respective strain from the ASKA collection (DNA Res 2005, 12, 291). A starter culture in selective LB medium (20 μg mL$^{-1}$ chloramphenicol) was inoculated from a single colony resulting from a streakout of the ASKA collection strain for MDH overexpression and left to grow overnight at 37° C. in a shaking incubator. The starter culture was then used on the next day to inoculate an expression culture in selective TB medium in a 1:100 dilution. The expression culture was grown at 37° C. in a shaking incubator to an OD$_{600}$ of 0.6, induced with 0.5 mM IPTG and grown for 4 more h at 37° C. in a shaking incubator.

The cells were harvested as described above. The MDH enzyme was purified in the same way as described above, except that buffer A contained 200 mM NaCl, 50 mM potassium phosphate pH 7.0, 15 mM imidazole, 1 mM β-mercaptoethanol, and one tablet of SIGMAFAST™ protease inhibitor cocktail, EDTA-free (Sigma-Aldrich) per L. Buffer C contained 100 mM NaCl, 50 mM potassium phosphate pH 7.0, and 0.1 mM DTT. The purified enzyme was stored at −20° C. in buffer C containing 50% glycerol.

Formate Dehydrogenase

The D221A mutant of the formate dehydrogenase from *Mycobacterium vaccae* (henceforth FDH enzyme) was overexpressed using a previously described construct (Appl Microbiol Biotechnol 2013, 97, 2473). The *E. coli* BL21 (DE3) cells transformed with this plasmid were grown on LB agar plates containing 100 μg mL$^{-1}$ ampicillin at 37° C. overnight. A starter culture in selective LB medium was then inoculated from a single colony on the next day and left to grow overnight at 37° C. in a shaking incubator. The starter culture was then used on the next day to inoculate an expression culture in selective TB medium in a 1:100 dilution. The expression culture was grown at 37° C. in a shaking incubator to an OD$_{600}$ of 1.5, induced with 0.5 mM IPTG and grown overnight at 25° C. in a shaking incubator.

The cells were harvested as described above. The FDH enzyme was purified in the same way as described above, except that buffer A contained 500 mM NaCl, 20 mM Tris pH 8.1, 10% glycerol, and one tablet of SIGMAFAST™ protease inhibitor cocktail, EDTA-free (Sigma-Aldrich) per L. Buffer C contained 200 mM NaCl and 20 mM Tris pH 8.1. The purified enzyme was stored at −20° C. in buffer C containing 50% glycerol.

Enzyme Activity Assays

In all enzyme assays, the oxidation of NADH or NADPH was followed at 340 nm or 360 nm on a Cary 60 UV-Vis photospectrometer (Agilent, Santa Clara, USA) in quartz cuvettes with a path length of 1 mm or 10 mm (Hellma Optik GmbH, Jena, Germany).

The enzyme assay to determine the kinetic parameters of AGAT with glyoxylate and L-aspartate as substrates was performed at 30° C. in a total volume of 300 μl. The reaction mixture contained 100 mM potassium phosphate buffer pH 7.5, 0.1 mM PLP, 0.2 mM NADH, varying amounts of the respective substrates, and 32 nM AGAT. Mdh was added in excess as coupling enzyme to convert oxaloacetate into malate. Kinetics for glyoxylate were measured with 20 mM L-aspartate; kinetics for L-aspartate were measured with 5 mM glyoxylate. To determine the kinetic parameters with oxaloacetate and glycine as substrates, the same assay mixture was used and GhrA was added in excess as coupling enzyme to convert glyoxylate into glycolate. Kinetics for glycine were measured with 20 mM oxaloacetate; kinetics for oxaloacetate were measured with 30 mM glycine. To determine the kinetic parameters with L-serine or L-glutamate and glyoxylate as substrates, the same assay mixture was used and BHAD, BHAA, and Mdh were added in excess as coupling enzymes. Kinetics for L-serine and L-glutamate were measured with 5 mM glyoxylate.

The enzyme assay to determine the kinetic parameters of BHAD was performed at 30° C. in a total volume of 300 μl. The reaction mixture contained 100 mM phosphate buffer pH 7.5, 0.1 mM PLP, 0.2 mM NADH, varying amounts of the substrate (2R,3S)-β-hydroxyaspartate, and 29 nM BHAD. ISRed was added in excess as coupling enzyme to convert iminosuccinate into L-aspartate. (2R,3S)-β-Hydroxyaspartate was custom-synthesized by NewChem (Newcastle upon Tyne, United Kingdom), and was determined to be >95% pure by NMR analysis.

The enzyme assay to determine the kinetic parameters of BHAA with glyoxylate and glycine as substrates was performed at 30° C. in a total volume of 1 ml. The reaction mixture contained 100 mM potassium phosphate buffer pH 7.5, 0.1 mM PLP, 0.2 mM NADH, 0.5 mM MgCl$_2$, varying amounts of the respective substrates, and 4 nM BHAA. BHAD and ISRed were added in excess as coupling enzymes. Kinetics for glycine were measured with 5 mM glyoxylate; kinetics for glyoxylate were measured with 20 mM glycine. To determine the kinetic parameters with (2R,3S)-β-hydroxyaspartate as substrate, the same assay mixture was used and GhrA was added in excess as coupling enzyme to convert glyoxylate into glycolate. To determine the kinetic parameters with D-threonine as substrate, the same assay mixture was used and alcohol dehydrogenase from Saccharomyces cerevisiae (Sigma-Aldrich, St. Louis, USA) was added in excess as coupling enzyme to convert acetaldehyde into ethanol.

The enzyme assay to determine the apparent kinetic parameters of ISRed was performed at 30° C. in a total volume of 250 μL. The reaction mixture contained 100 mM potassium phosphate buffer pH 7.5, 0.2 mM NADH, 0.1 mM PLP, varying amounts of (2R,3S)-β-hydroxyaspartate, and appropriate amounts of the enzymes BHAD and ISRed. Kinetics for iminosuccinate were measured with 15 nM ISRed, and appropriate amounts of (2R,3S)-β-hydroxyaspartate and BHAD to generate the desired concentrations of iminosuccinate at the onset of the reaction. Kinetics for NADH and NADPH were measured with 2 mM (2R,3S)-β-hydroxyaspartate, 214 nM BHAD, 28 nM ISRed, and varying amounts of the respective cofactor.

The enzyme assay to generate iminosuccinate from (2R,3S)-β-hydroxyaspartate (catalyzed by BHAD) and further chemical reduction of iminosuccinate to L-aspartate with the reducing agent NaCNBH$_3$ was performed at 30° C. in a total volume of 1 mL. The reaction mixture contained 50 mM Tris pH 7.5, 1 mM (2R,3S)-β-hydroxyaspartate, 0.1 mM PLP, 1 mM MgCl$_2$, 214 nM BHAD, and 1 mM NaCNBH$_3$. The reaction was carried out in D$_2$O. 180 μL aliquots were taken after 0, 0.5, 1, 2 and 3 minutes and the reaction was immediately stopped by quenching with formic acid (4% final concentration). The samples were centrifuged at 17,000× g and 4° C. for 15 min and the supernatant diluted 1:4 in double-distilled water for LC-MS analysis. In negative control experiments, NaCNBH$_3$ was omitted from the reaction mixture. The same experiment was performed with added ISRed instead of NaCNBH$_3$ in order to enzymatically reduce iminosuccinate to L-aspartate. The reaction mixture contained 50 mM Tris pH 7.5, 1 mM (2R,3S)-β-hydroxyaspartate, 2 mM NADH, 0.1 mM PLP, 1 mM MgCl$_2$, 214 nM BHAD and 28 nM ISRed.

LC-MS measurements were performed using an Agilent 6550 iFunnel Q-TOF LC-MS system equipped with an electrospray ionization source set to negative ionization mode. Liquid chromatography (LC) was carried out as follows: The analytes were separated on an aminopropyl column (30 mm×2 mm, particle size 3 μm, 100 Å, Luna NH2; Phenomenex, Torrance, USA) using a mobile phase system comprised of 95:5 20 mM ammonium acetate pH 9.3 (adjusted with ammonium hydroxide to a final concentration of approximately 10 mM)/acetonitrile (A) and acetonitrile (B). Chromatographic separation was carried out using the following gradient condition at a flow rate of 250 μl min$^{-1}$: 0 min 85% B; 3.5 min, 0% B, 7 min, 0% B; 7.5 min 85% B; 8 min 85% B. Column oven and autosampler temperature were maintained at 15° C. The ESI source was set to the following parameters: Capillary voltage was set at 3.5 kV and nitrogen gas was used as nebulizing (20 psig), drying (13 L min$^{-1}$, 225 C) and sheath gas (12 L min$^{-1}$, 400° C.). The QTOF mass detector was calibrated prior to measurement using an ESI-L Low Concentration Tuning Mix (Agilent, Santa Clara, USA) with residuals and corrected residuals less than 2 ppm and 1 ppm respectively. MS data were acquired with a scan range of 50-600 m/z. Autorecalibration was carried out using 113 m/z as reference mass. Subsequent peak integration of all analytes was performed using eMZed 2.29.4.0 (Bioinformatics 2013, 29, 963).

Generation of *P. denitrificans* Deletion Strains

The upstream and downstream flanking regions of the gene encoding for the ISRed enzyme from *P. denitrificans* DSM 413 were cloned into the gene deletion vector pRED-SIX (Appl Environ Microbiol 2016, 82, 2791). To this end, the flanking regions were amplified from genomic DNA of *P. denitrificans* DSM 413 with the primers

```
Upstream:
                                      (SEQ ID NO: 21)
5'-GGTCTGACAGGTTTAAACTCTAGACACGGCACCGAGCTG

GGCATCT-3'

(SEQ ID NO: 22)
5'-CGGCACGGGCATATGTCAGTAGCCCTTTCCGCGCGC-3'

Downstream:
                                      (SEQ ID NO: 23)
5'-AAAGGGCTACTGACATATGCCCGTGCCGCTCGCGTCCTG

A-3'

(SEQ ID NO: 24)
5'-CTTAAGGCTAGCATGCATCCTAGGCGGCATAGCGTGCGA

TCACCAGGATCG-3'
```

The upstream and downstream flanking regions of the gene encoding for the BHAA enzyme from *P. denitrificans* DSM 413 were cloned into the gene deletion vector pRED-SIX. To this end, the flanking regions were amplified from genomic DNA of *P. denitrificans* DSM 413 with the primers

```
Upstream:
                                      (SEQ ID NO: 25)
5'-GGTCTGACAGGTTTAAACTCTAGACGCTCGGGCAACCAT

GCCTCGT-3'

(SEQ ID NO: 26)
5'-CCTTTCCGCGCATATGGGGGCTCTCCTCAATTCTGGTTC

AG-3'

Downstream:
                                      (SEQ ID NO: 27)
5'-TGAGGAGAGCCCCCATATGCGCGGAAAGGGCTACTGATG

CTCG-3'

(SEQ ID NO: 28)
5'-CTTAAGGCTAGCATGCATCCTAGGCGGTGAAGATCCGTG

CGCGCGC-3'
```

The upstream and downstream flanking regions of the gene encoding for the BHAD enzyme from *P. denitrificans* DSM 413 were cloned into the gene deletion vector pRED-SIX. To this end, the flanking regions were amplified from genomic DNA of *P. denitrificans* DSM 413 with the primers

```
Upstream:
                                      (SEQ ID NO: 29)
5'-GGTCTGACAGGTTTAAACTCTAGACGCGCTGGACGCCGC

GAAACAC-3'

(SEQ ID NO: 30)
5'-CTCAATTCTGGTCATATGGGCGTCCTTCATCCTCAGGCG

G-3'

Downstream:
                                      (SEQ ID NO: 31)
5'-GATGAAGGACGCCCATATGACCAGAATTGAGGAGAGCCC

CATGAACGCG-3'

(SEQ ID NO: 32)
5'-CTTAAGGCTAGCATGCATCCTAGGCCCGTGCCGCCGCCC

GAGACGA-3'
```

The upstream and downstream flanking regions of the gene encoding for the AGAT enzyme from *P. denitrificans* DSM 413 were cloned into the gene deletion vector pRED-SIX. To this end, the flanking regions were amplified from genomic DNA of *P. denitrificans* DSM 413 with the primers

```
Upstream:
                                      (SEQ ID NO: 33)
5'-GGTCTGACAGGTTTAAACTCTAGACCGCTCCAGCCGCAT

CTCGCGC-3'

(SEQ ID NO: 34)
5'-GTCCTTCATCCCATATGGGCAATTCCTCCTGCGCTTGTG

GAC-3'

Downstream:
                                      (SEQ ID NO: 35)
5'-AGGAGGAATTGCCCATATGGGATGAAGGACGCCATGTAT

ATCC-3'

(SEQ ID NO: 36)
5'-CTTAAGGCTAGCATGCATCCTAGGCGGTCAGATCCTTCA

GCGGCAC-3'
```

The upstream and downstream flanking regions of the gene encoding for the 2-phosphoglycolate phosphatase enzyme (PGP enzyme) from *P. denitrificans* DSM 413 were cloned into the gene deletion vector pREDSIX. To this end, the flanking regions were amplified from genomic DNA of *P. denitrificans* DSM 413 with the primers

```
Upstream:
                                      (SEQ ID NO: 37)
5'-GGTCTGACAGGTTTAAACTCTAGACGAACATCAACC

GCCAACCAATC-3'

(SEQ ID NO: 38)
5'-CCGGACGGAGCATATGTCACGCCTTCCATTTGATCG

AG-3'

Downstream:
                                      (SEQ ID NO: 39)
5'-ATGGAAGGCGTGACATATGCTCCGTCCGGGCGCGGC

AACG-3'

(SEQ ID NO: 40)
5'-CTTAAGGCTAGCATGCATCCTAGGCAGGCCCAGAAG

GCCCAGGATGAACAGC-3'
```

In all five cases, the resulting PCR products were used to perform Gibson assembly with the vector pREDSIX, which had been digested with the endonuclease MfeI. Subsequently, the resulting vector was digested with the restriction endonuclease NdeI, and a kanamycin resistance cassette, which had been cut out of the vector pRGD-Kan (Appl Environ Microbiol 2016, 82, 2791) with the restriction endonuclease NdeI, was ligated into the cut site to generate the final vectors for gene deletion.

For gene deletion of the genes encoding for the ISRed, BHAA, BHAD, AGAT and PGP enzymes, respectively, the corresponding plasmid was first transformed into chemically competent *E. coli* ST18 (FEMS Microbiol Lett 2009, 294, 127) cells. The cells transformed with the respective plasmid were then grown on LB agar plates containing 100 µg mL$^{-1}$ ampicillin, 50 µg mL$^{-1}$ kanamycin and 50 µg mL$^{-1}$ aminolevulinic acid at 37° C. overnight. A culture in selective LB medium was then inoculated from a single colony of each transformation plate, respectively, on the next day and left to grow overnight at 37° C. in a shaking incubator. The cultures were diluted the next morning to an $OD_{600}$ of 0.1. A culture of *P. denitrificans* in LB medium was inoculated from a glycerol stock and grown at 30° C. in a shaking incubator. ST18 cultures were harvested at an $OD_{600}$ of ~0.7, and the *P. denitrificans* culture was harvested at an $OD_{600}$ of ~1.3. All cell pellets were washed once with sterile 10 mM $MgSO_4$ and resuspended to an $OD_{600}$ of ~10 in sterile 10 mM $MgSO_4$. Suspensions of ST18 cells and *P. denitrificans* cells were mixed in a 2:1 ratio and spotted on minimal medium agar plates without any carbon sources. One L of minimal medium contained the following components dissolved in double-distilled water: 0.5 g $NH_4CL$, 0.5 g $MgSO_4*7$ $H_2O$, 0.1 g $CaCl_2*2$ $H_2O$, 0.04 g $KH_2PO_4$, 0.12 g $K_2HPO_4$, 6 g HEPES and 1 ml of trace element solution (7.3 g $Na_2EDTA$, 2.5 g $FeSO_4*7$ $H_2O$, 0.02 g $MnCl_2*4$ $H_2O$, 0.242 g $Na_2MoO_4*2$ $H_2O$, 0.085 g $CuCl_2*2$ $H_2O$, 0.34 g $ZnCl_2$ per L). The pH of the medium was adjusted to 7.2 using NaOH before autoclaving, and the medium was solidified using 1.5% agarose. Plates were incubated at 30° C. overnight. The next morning, spots were removed from the plates, resuspended in LB medium and plated on LB agar plates containing 25 µg mL$^{-1}$ kanamycin. Plates were incubated at 30° C. for 3 days. Subsequently, the resulting colonies of the deletion strain were picked, the respective gene deletion was verified by colony PCRs and Sanger sequencing (Eurofins) and the deletion strain was propagated in selective LB medium High-Throughput Growth Assays with *P. denitrificans* Strains Cultures of gene deletion strains and the WT of *P. denitrificans* were pre-grown at 30° C. in LB medium containing 25 µg mL$^{-1}$ kanamycin. Then, cells were harvested, washed once with minimal medium containing no carbon source and used to inoculate growth cultures of 180 µL minimal medium containing 30 mM methanol or 30 mM methylamine as well as 25 pg mL$^{-1}$ kanamycin in 96-well plates (Thermo Scientific). Growth at 30° C. was monitored in at least technical triplicates at 600 nm in a Tecan Infinite M200Pro reader (Tecan). The resulting data was evaluated using the software GraphPad Prism 7.

Whole-Cell Shotgun Proteomics

To acquire the proteome of *P. denitrificans* growing on different carbon sources, 20 mL cultures were grown to mid-exponential phase ($OD_{600}$ ~0.5) in minimal medium supplemented with 60 mM acetate or 60 mM glycolate. 4 replicate cultures were grown for each carbon source. Main cultures were inoculated from precultures grown in the same medium in a 1:1,000 dilution. Cultures were harvested by centrifugation at 4,000× g and 4° C. for 15 min. Supernatant was discarded and pellets were washed in 40 mL phosphate buffered saline (PBS; 137 mM NaCl, 2.7 mM KCl, 10 mM $Na_2HPO_4$, 1.8 mM $KH_2PO_4$, pH 7.4). After washing, cell pellets were resuspended in 1 mL PBS, transferred into Eppendorf tubes, and repeatedly centrifuged. Cell pellets in Eppendorf tubes were snap-frozen in liquid nitrogen and stored at −80° C. until they were used for the preparation of samples for LC-MS analysis and label-free quantification.

For whole cell lysis, cell pellets were first resuspended in 200 µL $NH_4HCO_3$ (100 mM supplemented with 5% SDS). Then, 5 µL TCEP (200 mM in 100 mM $NH_4HCO_3$) were added and samples were sonicated (2×10 sec). Subsequently, samples were heated at 90° C. while shaking at 500 rpm for 15 min. After addition of 5 µL iodacetamide (400 mM in HPLC water), lysates were cleared by centrifugation at 15,000 rpm for 10 min. Protein concentration in samples was determined via Pierce™ BCA assay (Thermo Scientific). 50 µg protein were used for the following reactions for protein digestion and peptide purification via the SP3 (single-pot solid phase-enhanced sample preparation) method (Hughes, Foehr et al. 2014). SP3 was carried out using 5 µL 1:1 Sera-Mag SP3 bead mix. Protein digestion with trypsin occurred in the presence of 10% acetonitrile. Peptide mixes were recovered in 2% DMSO and then in 0.5% trifluoracetic acid (TFA) and analyzed via LC-MS on an electrospray ion source-connected Thermo QExactive Plus mass spectrometer (Thermo Scientific). Peptide separation was performed on an in-house packed C18 (1.9 µm; Dr. Maisch) RP-HPLC column (75 µm×35 cm) in an Ultimate 3000 RSLCnano system (Thermo Scientific) applying a separation gradient of 98% solvent A (0.15% formic acid) and 2% solvent B (80% acetonitrile, 0.15% formic acid) to 32% solvent B over 175 min and to 5% solvent B for an additional 2 min at a flow rate of 300 nL/min. Label-free data quantification was performed according to (Nature 2011, 473, 337; Proteomics 2013, 13, 2567; and J Proteome Res 2015, 14, 4472). The obtained data was aligned to the *P. denitrificans* database downloaded from www.uniprot.org.

Electrophoretic Mobility Shift Assays

Fluorescently labeled DNA fragments for electrophoretic mobility shift assays (EMSA) were generated by PCR from genomic DNA of *P. denitrificans* DSM 413. For the Pbhc regulatory region, primers Pbhc_fw and Pbhc_rev-dye were used to generate a 238-bp fragment containing the putative Pbhc promoter. The primers AGAT-Fw and AGAT_rev-dye were used to generate a 255-bp fragment containing a fragment of the AGAT gene as negative controle. Pbhc rev dye and AGAT rev dye were 5'-labelled with the Dyomics 781 fluorescent dye (Microsynth AG, Balgach, Switzerland). Binding reactions between the DNA fragments (0.025 pmol), various amounts of the purified protein BhcR (400x/2,000x/4,000x/10,000x/20,000x/40,000x molar excess), and various concentrations of glyoxylate (0.01/0.05/0.1/0.2/0.5/1 mM final concentration) were performed in buffer A (20 mM potassium phosphate pH 7.0, 1 mM DTT, 5 mM $MgCl_2$, 50 mM KCl, 15 µg mL$^{-1}$ bovine serum albumin, 50 µg mL$^{-1}$ herring sperm DNA, 5% v/v glycerol, 0.1% Tween20) in a total volume of 20 µL. After incubation of the reaction mixtures at 37° C. for 20 min, the samples were loaded onto a native 5% polyacrylamide gel and electrophoretically separated at 110 V for 60 min. BhcR:DNA-interactions were detected using an Odyssey FC Imaging System (LI-COR Biosciences, Lincoln, USA).

Crystallization and Structure Determination of BHAA and ISRed

The sitting-drop vapor-diffusion method was used for crystallization at 16° C. Purified BHAA (10 mg mL$^{-1}$) was mixed in a 1:1 ratio with solution A containing 20% PEG 3350, 0.2 M ammonium chloride, pH 6.3 (final drop volume 1.4 µL). Reservoirs were filled with 40 µL solution A. Crystals appeared within 14 days. Crystals were briefly soaked in mother liquor supplemented with 40% glycerol for cryoprotection before freezing in liquid nitrogen.

Purified ISRed (5 mg ml$^{-1}$) was mixed in a 1:1 ratio with solution B containing 20% PEG 3350, 0.06 M BIS-TRIS propane, and 0.04 M citric acid, pH 6.4 (final drop volume 4 µL). Reservoirs were filled with 114 µL of solution B. Crystals appeared within 12 days. Crystals were briefly soaked in mother liquor supplemented with 12 mM NAD$^+$ and 40% MPD (2-Methyl-2,4-pentanediol) for cryoprotection before freezing in liquid nitrogen.

X-ray diffraction data were collected at the beamlines ID29 and ID30B of the ESRF (Grenoble, France). The data was processed with the XDS (Kabsch, W. (2010). "Xds." *Acta Crystallogr D Biol Crystallogr* 66(Pt 2): 125-132). (BUILT 20180126) and CCP4 7.0 software packages (Winn et al. "Overview of the CCP4 suite and current developments." *Acta Crystallogr D Biol Crystallogr* 67(Pt 4): 235-242). The structures were solved by molecular replacement. For BHAA the structure of a D-threonine aldolase (PDB ID 4V15) (Uhl et al. "The crystal structure of D-threonine aldolase from Alcaligenes xylosoxidans provides insight into a metal ion assisted PLP-dependent mechanism." *PLoS One* 10(4): e0124056.) served as search model. For ISRed a homology model was made based on the structure of L-alanine dehydrogenase (PDB ID 1OMO) (Gallagher et al. "Structure of alanine dehydrogenase from Archaeoglobus: active site analysis and relation to bacterial cyclodeaminases and mammalian mu crystallin." *J Mol Biol* 342(1): 119-130.) using Swiss-Model (Waterhouse et al. "SWISS-MODEL: homology modelling of protein structures and complexes." *Nucleic Acids Res* 46(W1): W296-W303.). This homology model was then used as search model for the molecular replacement. The molecular replacement was carried out using Phaser of the Phenix software package (Adams et al. PHENIX: a comprehensive Python-based system for macromolecular structure solution." Acta Crystallogr D Biol Crystallogr 66(Pt 2): 213-221.) (version 1.14), built with Phenix.Autobuild, and refined with Phenix.Refine. Additional modeling, manual refining and ligand fitting was done in Coot (Emsley et al. "Coot: model-building tools for molecular graphics." *Acta Crystallogr D Biol Crystallogr* 60(Pt 12 Pt 1): 2126-2132.) (version 0.8.9). Final positional and B-factor refinements, as well as water-picking for the BHAA structure were performed using Phenix.Refine. The structure models for BHAA and ISRed were deposited at the Protein Bata Bank in Europe (PDBe) under the PDB ID 6QKB and 6QKH, respectively. Figures were made using Pymol 1.8.

Genetic Engineering of *S. elongatus*

Nucleotide sequences comprising the genes encoding for the ISRed, BHAA, BHAD and AGAT enzymes as well as the BHAR protein (all codon-optimized for expression in *Synecchococcus elongatus* PCC7942; SEQ ID NO 43 to 47) were ordered from the company Eurofins (Ebersberg, Germany). The synthesized nucleotide sequences of the ISRed, BHAA, BHAD and AGAT enzymes were then PCR-amplified with the following primers:

ISRed
(SEQ ID NO: 50)
5'-CAAGGGTTACTAGACCAGAATTAGGAGAAGATCTATG

CTAGTGGTG-3'

(SEQ ID NO: 51)
5'-TCCCTCGAGTTAGGATCCCATATGACTAGATTTCGAC

CTCCTGAGC-3'

BHAA
(SEQ ID NO 52)
5'-GTCTAGAGAATTCCACACAGGAGAAGATCTATGAATG

CGAAAACAGACTTCAG-3'

(SEQ ID NO: 53)
5'-TCCTAATTCTGGTCTAGTAACCCTTGCCGCGGGC-3'

BHAD
(SEQ ID NO: 54)
5'-GAAGGCCGCCTAGACCAGAATTAGGAGAAGATCTATG

TACATTCCGACC-3'

(SEQ ID NO: 55)
5'-GGACTCGAGTTAGGATCCCATATGACTAGTTCCACGG

CAATTTATC-3'

AGAT
(SEQ ID NO: 56)
5'-GTCTAGAGAATTCCACACAGGAGAAGATCTATGACCT

CCCAAAATCCAATTTTTATTC-3'

(SEQ ID NO: 57)
5'-TCCTAATTCTGGTCTAGGCGGCCTTCTTCTGGGC-3'

The resulting PCR products were used for Gibson assembly reactions (Gibson et al. "Enzymatic assembly of DNA molecules up to several hundred kilobases." *Nat Methods* 2009, 6(5): 343-345.) in the following combinations: the ISRed sequence and the BHAA sequence were introduced into the vector pNS3_cpt_bb (previously cut with the endonuclease BglII) and the BHAD sequence and the AGAT sequence were introduced into the vector pSyn6_cpt_bb (previously cut with the endonuclease BglII). The promoter sequences pLavUV_bb and pCpt_bb (SEQ ID NO 48 and 49) were ordered as synthetic nucleotide sequences from the company IDT (San Diego, USA). pNS3_cpt_bb was constructed by using the plasmid pNS3 (Niederholtmeyer et al. "Engineering cyanobacteria to synthesize and export hydrophilic products." *Appl Environ Microbiol* 2010, 76(11): 3462-3466.) and introducing a point mutation in order to remove a XhoI cut site by single oligo mutagenesis using the primer (SEQ ID NO: 58)
5'-GTTGCCGTGACGCCGACTGTCTGGAGTATCTAGTCGC

GTTG-3'

The resulting plasmid pNS3_A was cut with the restriction endonucleases SexAI and XhoI. The promoter sequence pLavUV_bb was also cut with the restriction endonucleases SexAI and XhoI, and the two fragments were ligated to create the plasmid pNS3_pLavUV_bb. This plasmid was then cut with the restriction endonucleases NcoI and XhoI (removing the promoter sequence pLavUV_bb), and the promoter sequence pCpt_bb (Markley et al. "Synthetic biology toolbox for controlling gene expression in the cyanobacterium *Synechococcus* sp. strain PCC 7002." *ACS Synth Biol* 2015, 4(5): 595-603.) was also cut with the restriction endonucleases NcoI and XhoI. The two fragments were ligated to create the plasmid pNS3_cpt_bb.

pSyn6_cpt_bb was constructed by using the plasmid pSyn6 (commercially available from Thermo Fisher Scientific, Darmstadt, Germany) and introducing a point mutation in order to generate a HindIII cut site by single oligo mutagenesis using the primer

```
                                                    (SEQ ID NO: 59)
5'-GCGAAGTCGAGGCATTTCTGTCCTGGCTGGCTATTAAGCTTCTT
CTAATCCAGTGTAGACAGTAG-3'
```

The resulting plasmid (pSyn6_A) was cut with the restriction endonucleases HindIII and XhoI. The pCpt sequence was PCR-amplified from the plasmid pNS3_cpt_bb using the following primers:

```
                                                    (SEQ ID NO: 60)
5'-TATAAGCTTCAACGATGAGGGACTGG-3'

(SEQ ID NO: 61)
5'-CGATCCCTCGAGTTAGGATC-3'
```

The resulting PCR product was also cut with the restriction endonucleases HindIII and XhoI, and ligated with the equally digested pSyn6_A to create the plasmid pSyn6_cpt_bb.

The resulting plasmids were then used for transformation into *S. elongatus* PCC7942. To this end, an exponentially growing culture of said bacterium in BG-11 medium (Allen et al. "Growth and division of some unicellular blue-green algae." *J Gen Microbiol* 1968, 51(2): 199-202.) was aliquoted into sterile tubes at an $OD_{730}$ of 3, and then 750 µg of the plasmid to be transformed was added. The tubes were incubated overnight in the dark in a shaking incubator kept at 30° C. containing an atmosphere with 3% $CO_2$. On the next day, the cell suspension was spotted on membrane filters (Whatman; 47 mm diameter, 0.4 µm pore size) placed on selective BG-11 agar plates, which were incubated at 30° C. in constant light in an atmosphere with 3% $CO_2$ for 7 days. Cells grown on these plates were used to inoculate 1 ml liquid cultures in selective BG-11 medium. Cells grown in these liquid cultures were used for diagnostic PCRs to verify integration of the sequences encoding for the ISRed and BHAA enzymes or for the BHAD and AGAT enzymes, respectively, into the chromosome as desired. Strains identified as containing the desired sequences were further cultured in selective BG-11 medium in a shaking incubator containing an atmosphere with 3% $CO_2$ in constant light at 30° C.

Enzyme Activity Assays in *S. elongatus* Cell Extracts

*S. elongatus* cultures grown in BG11 medium were harvested during mid-exponential phase ($OD_{730}$ 1-1.5), resuspended in ice-cold 100 mM potassium phosphate buffer (pH 7.2) and lysed by sonication. Cell debris was separated by centrifugation at 35,000× g and 4° C. for 1 h. Total protein concentration of the resulting cell-free extracts was determined by Bradford assay (Bradford 1976) using bovine serum albumin as standard. The assays for activity of AGAT/BHAD/BHAA/ISRed were performed as described above, except that 100 mM potassium phosphate buffer pH 7.5 was replaced with 100 mM Tris pH 7.5.

Growth Assays with Engineered *S. elongatus* Strains

*S. elongatus* pre-cultures were grown in BG11 medium with the appropriate antibiotics at 30° C. at 110 rpm and 1% $CO_2$. Subsequently, these cultures were used to inoculate three replicate cultures of 50 mL per strain for growth assays to an initial OD730 of 0.05. No antibiotics were added to these cultures. They were incubated at 30° C. at 110 rpm and 0.5% $CO_2$. Samples were taken twice per day under sterile conditions and used to determine OD730 of the cultures. If necessary, the samples were diluted with BG11 medium to allow for a measured OD730 below 1. Growth assays at 37° C. were performed in the same way.

Example 1—Kinetic Characterization of the Enzymes of the β-hydroxyaspartate Pathway (BHAP) and Reconstruction of the BHAP In Vitro The genes encoding for the four enzymes of the BHAP in the genome of *Paracoccus denitrificans* DSM 413 were identified and these four proteins were heterologously expressed in *E. coli*. The four enzymes were purified and subjected to kinetic characterization by conducting suitable enzyme assays. Kinetic parameters of the enzymes are summarized in Table 1. The complete reaction sequence of the BHAP, catalyzed by these four enzymes, is shown in FIG. 1.

Figure 2:
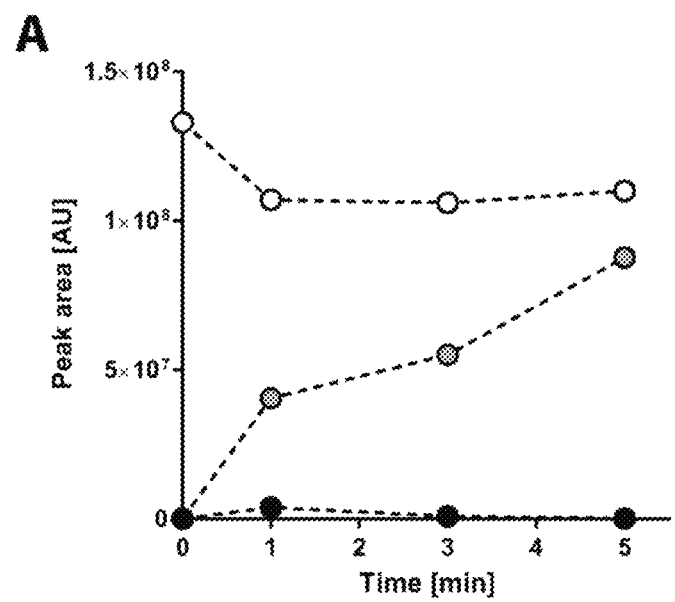
FIG. 2: In vitro assay with the four enzymes of the BHAP and malate dehydrogenase. Metabolites were quantified via LC-MS analysis. Glyoxylate (not measurable with this method) and aspartate (white circles) were added to produce malate (grey circles), as shown in panel A. The intermediate metabolites of the pathway (erythro-β-hydroxyaspartate, oxaloacetate, iminosuccinate) were also measured successfully, as shown in panel A and B.
Figure 2:
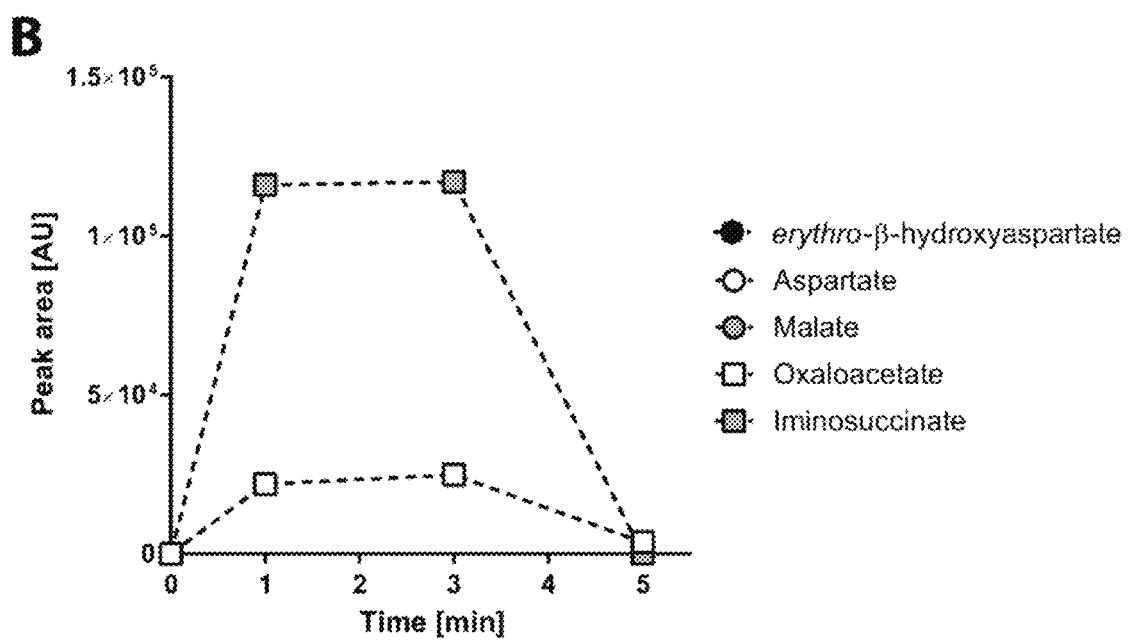

To assess the efficiency of the BHAP in converting its input molecule (glyoxylate) into its output molecule (oxaloacetate), a combined assay of all four enzymes was conducted. Additionally, the enzymes malate dehydrogenase (MDH) and formate dehydrogenase (FDH) were added. MDH converts oxaloacetate into malate, which can be analyzed well via LC-MS, while FDH as cofactor regeneration system is required for the regeneration of the cofactor NADH by oxidation of formate to carbon dioxide. The results of this assay are shown in FIG. 2 and demonstrate that the BHAP converts glyoxylate into malate with high speed and efficiency.

Furthermore, this assay demonstrates that the concentration of the required co-substrate aspartate remains largely the same over the course of the assay. With these in vitro results the stability and effectiveness of the enzyme-catalyzed reaction network is demonstrated that is the BHAP, which suggests that the pathway can also be used with high efficiency in a host microorganism, especially since it would not deplete the intracellular aspartate pool too much.

TABLE 1

Kinetic data of the four enzymes of the β-hydroxyaspartate pathway.

| Enzyme | Substrate | app. $k_{cat}$ [$s^{-1}$] | app. $K_M$ [mM] | app. $k_{cat}/K_M$ [$M^{-1} s^{-1}$] |
|---|---|---|---|---|
| ISRed | Iminosuccinate | 201.04 ± 10.20 | 0.088 ± 0.010 | 2.29 * $10^6$ |
|  | NADH | — | 0.023 ± 0.003 | — |
|  | NADPH | — | 0.33 ± 0.05 | — |
| BHAA | Glyoxylate | 85.96 ± 3.64 | 0.23 ± 0.03 | 3.72 * $10^5$ |
|  | Glycine | 90.98 ± 2.41 | 4.31 ± 0.34 | 2.11 * $10^4$ |
|  | (2R,3S)-β-hydroxy-aspartate | 33.11 ± 1.29 | 0.28 ± 0.03 | 1.18 * $10^5$ |
|  | D-Threonine | 76.21 ± 2.49 | 9.24 ± 0.86 | 8.25 * $10^3$ |
| BHAD | (2R,3S)-β-hydroxy-aspartate | 35.01 ± 0.82 | 0.20 ± 0.02 | 1.75 * $10^5$ |
| AGAT | Glyoxylate | 58.07 ± 0.82 | 0.43 ± 0.02 | 1.34 * $10^5$ |
|  | L-Aspartate | 56.36 ± 0.73 | 2.51 ± 0.10 | 2.25 * $10^4$ |
|  | Glycine | 0.76 ± 0.01 | 9.52 ± 0.40 | 7.97 * $10^1$ |
|  | Oxaloacetate | 0.76 ± 0.02 | 2.90 ± 0.27 | 2.62 * $10^2$ |
|  | L-Serine | 8.82 ± 0.31 | 2.10 ± 0.24 | 4.20 * $10^3$ |
|  | L-Glutamate | 5.03 ± 0.26 | 20.62 ± 2.33 | 2.44 * $10^2$ |

Example 2—Investigation of *P. denitrificans* BHAP Deletion Mutants and Demonstration of the Role of the BHAP in Photorespiration

*P. denitrificans* was grown on methanol as sole source of carbon and energy. During this mode of growth (termed methylotrophic autotrophy), methanol is fully oxidized to carbon dioxide, which is then fixed by the Calvin-Benson- Bassham cycle to generate biomass (Cox et al. Biochem. J. 1975, 150, 569). To investigate whether *P. denitrificans* depends on photorespiration during operation of the CBB cycle, the inventors knocked out the gene for 2-phosphoglycolate phosphatase (pgp), the first enzyme necessary for the detoxification of 2-phosphoglycolate, and tested growth of the mutant strain on methanol. While the wild-type strain grows on methanol with a doubling time of ~7 h under normal atmospheric conditions, the Δpgp strain did not grow at all, suggesting the formation and accumulation of toxic 2-phosphoglycolate.

Figure 3:
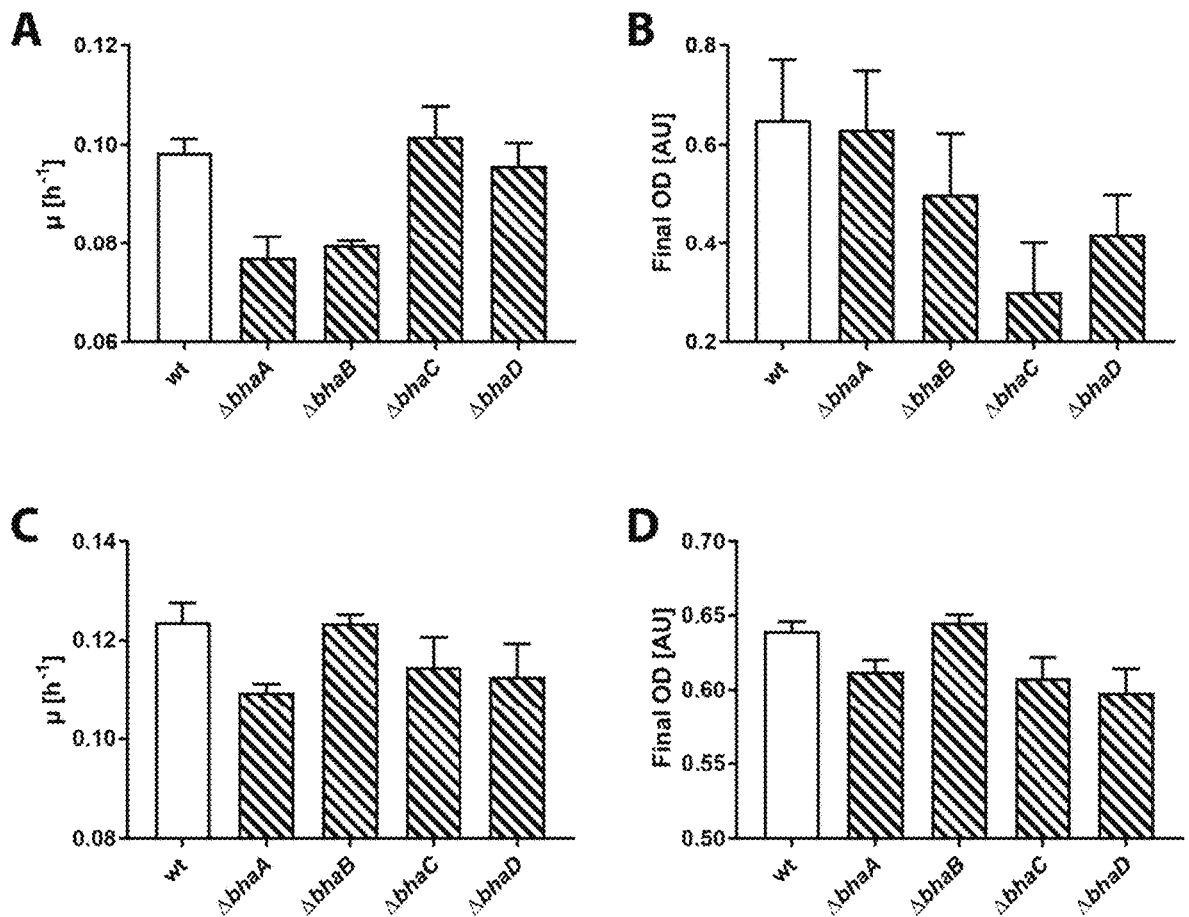
FIG. 3: Growth rates (A, C) and final optical densities (B, D) of cultures of *P. denitrificans* wt and ΔbhaA-D. Shown are average±standard deviation (n≥5) from growth on 30 mM methanol (A, B) or 30 mM methylamine (C, D) as carbon source. Note the marked decrease in growth rate and final optical density of the deletion strains on both C1 carbon sources.

To elucidate the potential role of the BHAP in photorespiration, single knockout strains of all four genes of the BHAP operon (ΔbhaA-bhaD) were generated. When testing growth of these strains on the C1 carbon sources methanol and methylamine, the results indicated that the deletions clearly decreased growth rate and biomass yield of the organism (see FIG. 3). Therefore, a functional BHAP is necessary for optimal autotrophic growth of *P. denitrificans* due to its role in photorespiration and can be expected to also increase growth rate and biomass yield in other microorganisms that suffer from the shortcomings of RuBisCO.

Figure 4:
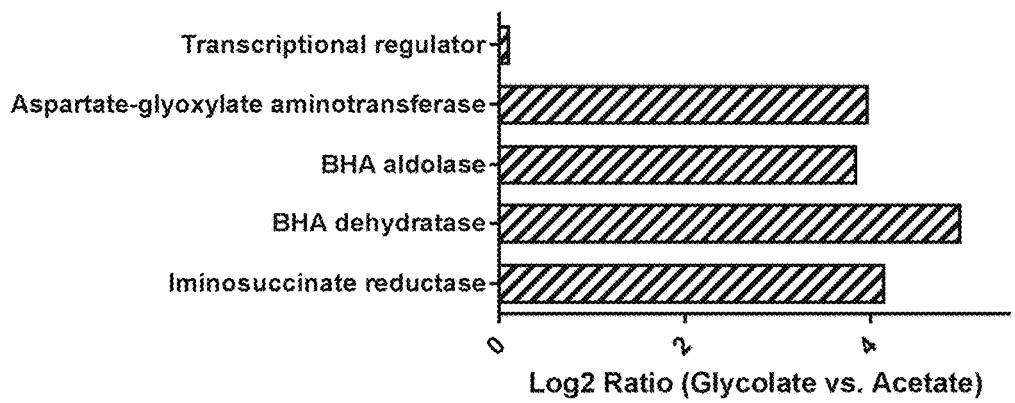
FIG. 4: Log2 ratios of the expression levels of the four enzymes of the BHAP as well as the associated transcriptional regulator (BHAR) in glycolate-grown vs. acetate-grown cells of *P. denitrificans*.

Example 3—Demonstration of the Inducibility of BHAP Expression in the Presence of the Effector Glyoxylate A whole-cell shotgun proteomics experiment was performed to investigate the expression levels of enzymes of the BHAP in cultures of *P. denitrificans* grown with different carbon substrates. As shown in FIG. 4, glycolate-grown cells show a strongly increased expression of all four enzymes of the BHAP compared to acetate-grown cells, while the expression level of the adjacent transcriptional regulator (BHAR) remains essentially unchanged. This suggests that either glycolate or a downstream reaction product thereof specifically induces expression of the enzymes of the BHAP.

Figure 5:
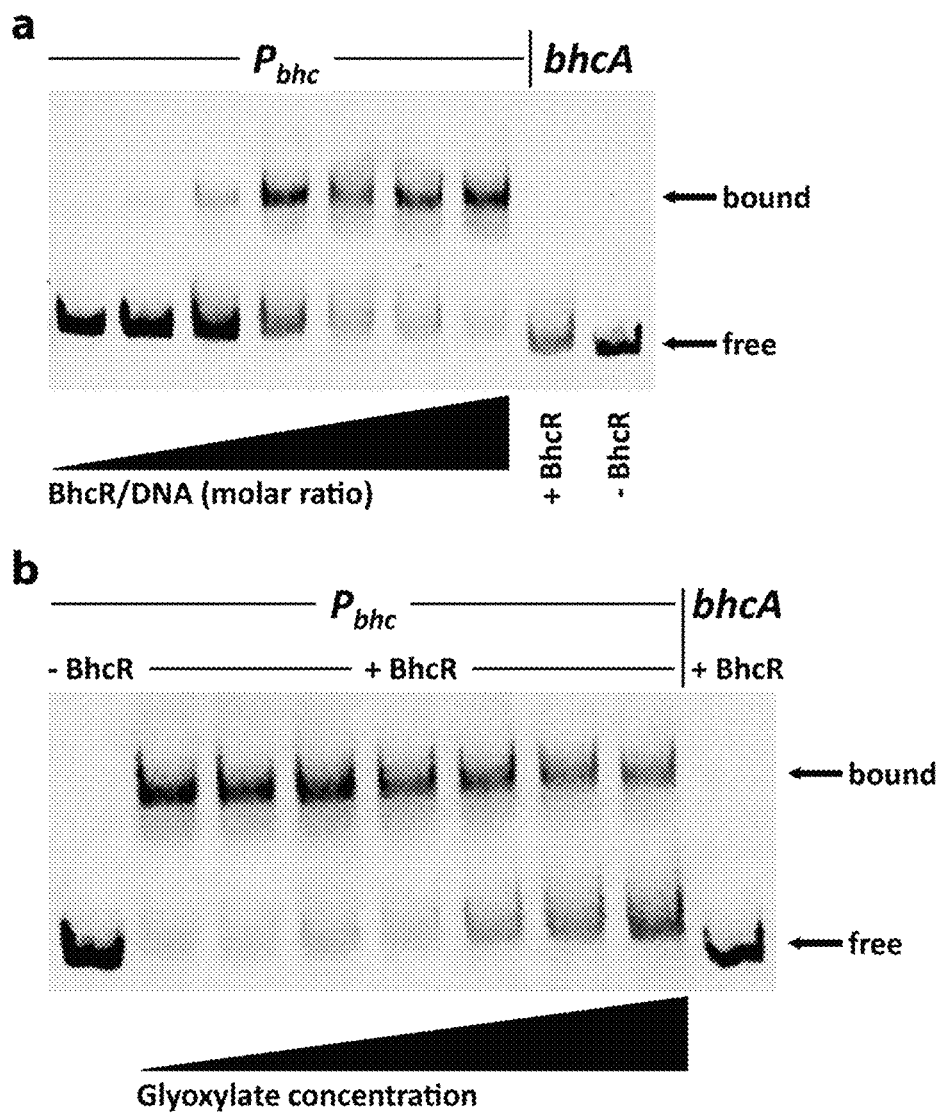
FIG. 5: Electrophoretic mobility shift assay (EMSA) to investigate promoter binding of BHcR. a, A fluorescently labeled DNA fragment carrying the putative promoter region of the bhc gene cluster ($P_{bhc}$) was incubated with increasing amounts of purified BhcR protein and subsequently electrophoretically separated to visualize DNA bound to BhcR and free DNA; a DNA fragment derived from the coding region of bhcA was used as a negative control. BhcR specifically forms a complex with the $P_{bhc}$ DNA fragment. b, The $P_{bhc}$-BhcR complex was incubated with increasing concentrations of glyoxylate and subsequently electrophoretically separated to assess the effect of glyoxylate on complex formation; the bhcA DNA fragment together with BhcR was used as a negative control. Increasing concentrations of glyoxylate decrease the binding of BhcR to the $P_{bhc}$ DNA fragment.

Therefore, the DNA-binding properties of BHAR were determined by incubating the purified BHAR protein together with a DNA fragment of the operon's promoter region. As shown in FIG. 5, the protein bound to the promoter region (compare lane 1 and 2). This binding was decreased when adding increasing concentrations of glyoxylate (lanes 3-6), indicating that this metabolite is an effector of BHAR and regulates the expression of the enzymes of the BHAP. Thus, due to the regulatory protein the BHAP can be induced by increasing intracellular levels of glyoxylate, when implemented in heterologous host microorganisms.

Figure 6:
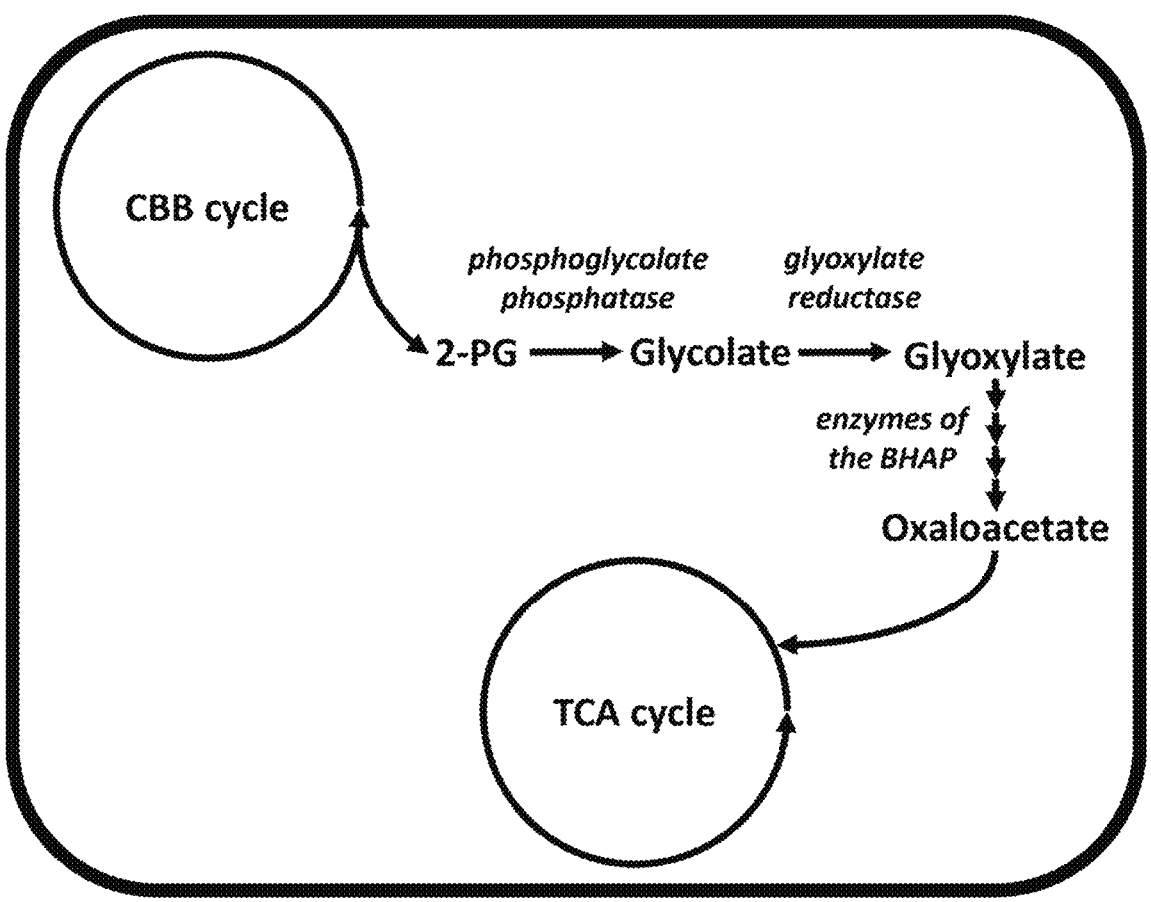
FIG. 6: The reaction sequence to convert 2-phosphoglycolate (2-PG), a toxic side product of photosynthesis, into oxaloacetate, a metabolite of the TCA cycle, via the BHAP together with two additional enzymes. This projected pathway could be implemented in any photosynthetic organism that is fixing $CO_2$ via the CBB cycle. Depending on the host organism, additional transporter proteins might be necessary to transport metabolites in and out of organelles (e.g. chloroplasts).

Example 4—Implementing the BHAP as a Heterologous Photorespiration Bypass Pathway to Increase the Autotrophic Efficiency of Microorganisms The experiments described above provide several lines of evidence supporting the notion that the BHAP can be applied as an inducible, heterologous photorespiration pathway in photosynthetic microorganisms. This means that with the addition of the two enzymes phosphoglycolate phosphatase and glyoxylate reductase (Hardy et al. Planta 1986, 168, 245; and Clark et al. Biochem J. 2009, 423, 15), the BHAP should be able to convert 2-phosphoglycolate, the toxic side product of photosynthesis, into a key metabolite in central carbon metabolism (see Table 2 and FIG. 6), notably without the release of $CO_2$ and with low energy requirements, compared to other natural photorespiration pathways (see Table 3).

TABLE 2

Required enzymes to convert 2-phosphoglycolate into oxaloacetate in the projected photorespiratory bypass. Substrates and products of all enzymes are given, with possible cofactors indicated in brackets.

| Reaction/Enzyme no. | EC no. of enzyme to be employed | Enzyme to be employed | Examples for organisms | Natural plant localization | Substrate(s) | Product(s) | Reference |
|---|---|---|---|---|---|---|---|
| 1 | 3.1.3.18 | phosphoglycolate phosphatase | ubiquitous | chloroplast | 2-phosphoglycolate, $H_2O$ | glycolate, phosphate | Planta 1986, 168, 245 |
| 2 | 1.1.1.26 | glyoxylate reductase | *Arabidopsis thaliana* | chloroplast | glycolate (NAD(P)) | glyoxylate (NAD(P)H) | Biochem J. 2009, 423, 15 |
| 3 | 2.6.1.X (not yet given) | aspartate-glyoxylate transaminase | *Paracoccus denitrificans* | — | aspartate, glyoxylate | oxaloacetate, glycine | |
| 4 | 4.1.3.14 | etythro-13-hydroxyaspartate aldolase | *Paracoccus denitrificans* | — | glyoxylate, glycine | etythro-β-hydroxyaspartate | |
| 5 | 4.3.1.20 (former 4.2.1.38) | etythro-13-hydroxyaspartate dehydratase | *Paracoccus denitrificans* | — | etythro-β-hydroxyaspartate | iminosuccinate, $H_2O$ | Biochem. J. 1965, 97(2), 547 |
| 6 | 1.5.1.X (not yet given) | iminosuccinate reductase | *Paracoccus denitrificans* | — | iminosuccinate (NADH) | aspartate (NAD) | |

TABLE 3

Comparison of previously published natural photorespiration pathways with the BHAP regarding their substrates, products, and energy requirements. Note that the BHAP compares favorably to all other pathways both in carbon balance and in required energy input.

| Pathway | Substrate(s) | Product(s) | Required ATP | Required reducing equivalents |
|---|---|---|---|---|
| Glycerate pathway | 2 glyoxylate | phosphoglycerate + $CO_2$ | 1 | 1 |

TABLE 3-continued

Comparison of previously published natural photorespiration pathways with the BHAP regarding their substrates, products, and energy requirements. Note that the BHAP compares favorably to all other pathways both in carbon balance and in required energy input.

| Pathway | Substrate(s) | Product(s) | Required ATP | Required reducing equivalents |
|---|---|---|---|---|
| Glycine cleavage pathway | 2 glyoxylate + glutamate | phosphoglycerate + $CO_2$ + 2-oxoglutarate + $NH_3$ | 1 | 1 |
| Glyoxylate oxidation | 2 glyoxylate | 4 $CO_2$ | — | 2 |
| BHAP | 2 glyoxylate | oxaloacetate | — | 1 |

Example 5—Implementing the BHAP as a Heterologous Photorespiration Bypass Pathway into Cyanobacteria The four genes of the BHAP were successfully integrated at two different neutral sites of the *S. elongatus* PCC7942 chromosome. This was done both in the WT strain and in a deletion strain that lacks the genes necessary for the formation of carboxysomes (ccmK-O), and therefore requires elevated atmospheric $CO_2$ concentrations for growth (this strain is henceforth referred to as ΔK-O). Subsequently, successful expression of the pathway enzymes was verified by measuring enzyme activities in cell-free extracts.

Figure 7:
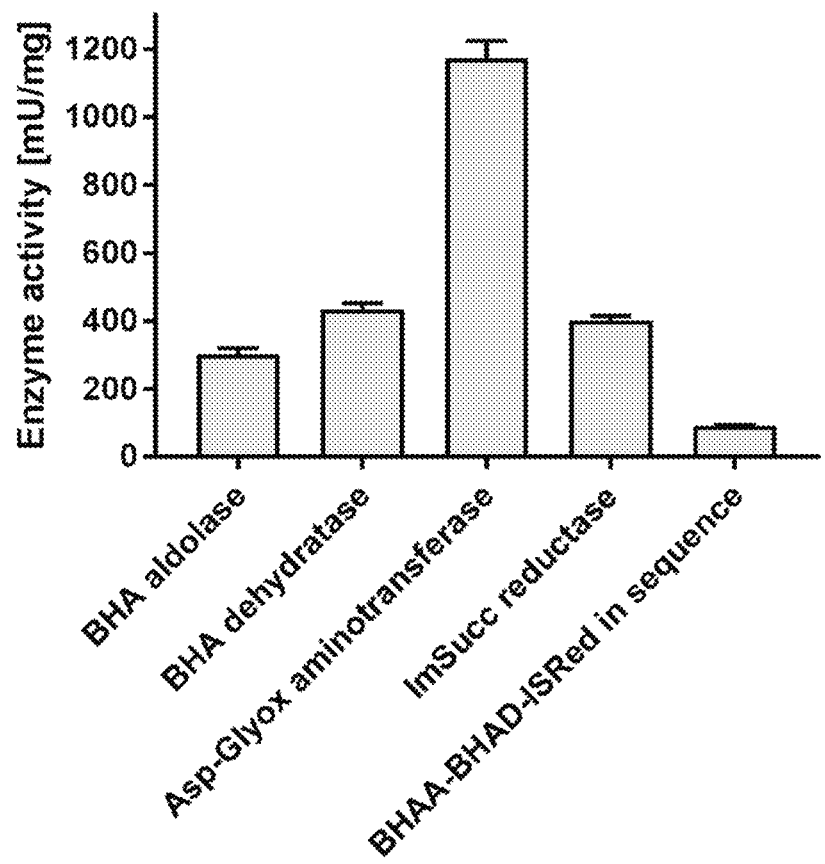
FIG. 7: shows the activities of BHAP enzymes measured in cell-free extracts of *S. elongatus* PCC7942 ΔK-O. To determine the single enzyme activities, required coupling enzymes were added in excess. The rightmost bar shows the activity of the BHAA-BHAD-ISRed reaction sequence, measured without additional coupling enzymes. The average of three replicates is shown; error bars represent standard deviations.

As shown in FIG. 7, the activity of each single enzyme in the ΔK-O strain was at least 300 mU/mg, while the reaction sequence from glycine and glyoxylate to aspartate (via BHA aldolase, BHA dehydratase and iminosuccinate reductase) was measured at an activity of ~100 mU/mg, notably without any additional coupling enzymes. It can therefore be assumed that the expression level of the BHAP enzymes is high enough to sustain photorespiratory flux in *S. elongatus* PCC7942 ΔK-O.

Figure 8:
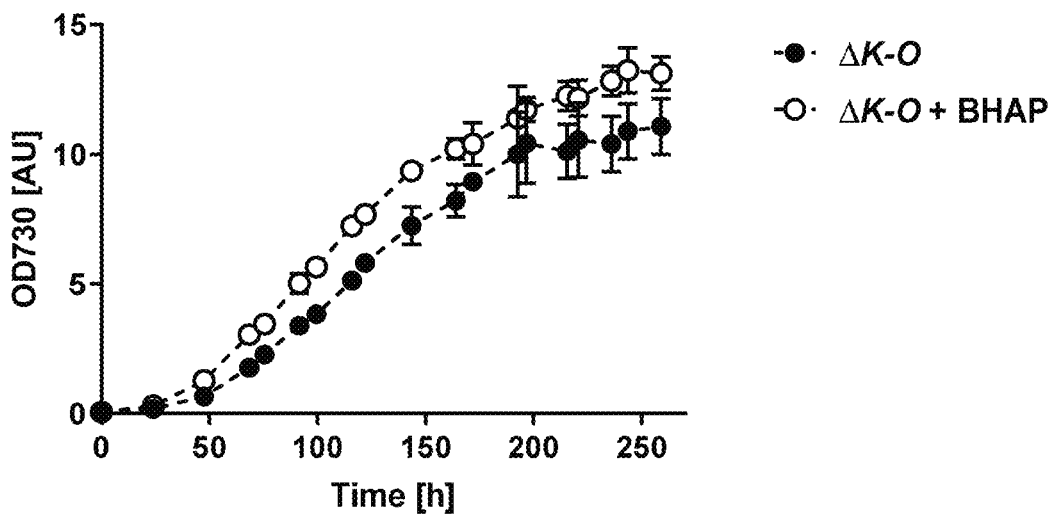
FIG. 8: shows the Growth curves of engineered cyanobacterial strains at 30° C. Three replicate cultures of each strain were grown in a light incubator in an atmosphere containing 0.5% $CO_2$. Samples were taken twice each day, and $OD_{730}$ was measured manually in a spectrophotometer after suitable dilution. The average of three replicates is shown; error bars represent standard deviations.
Figure 9:
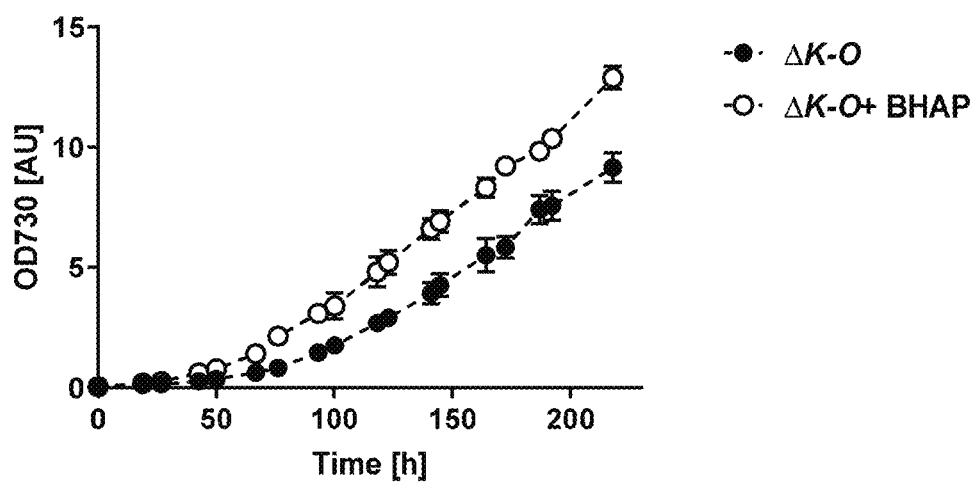
FIG. 9: shows the Growth curves of engineered cyanobacterial strains at 37° C. Three replicate cultures of each strain were grown in a light incubator in an atmosphere containing 0.5% $CO_2$. Samples were taken twice each day, and $OD_{730}$ was measured manually in a spectrophotometer after suitable dilution. The average of three replicates is shown; error bars represent standard deviations.

Next, it was tested whether the implementation of the BHAP in the ΔK-O background conferred a specific phenotype due to improved capabilities for photorespiration. To this end, three replicate cultures (50 mL in baffled shake flasks) of each strain were grown at 30° C. in a light incubator in an atmosphere containing 0.5% $CO_2$, and growth curves were recorded. This experiment was independently repeated three times; FIG. 8 shows representative growth curves from one of the three experiments. The same experiment was also conducted once at 37° C. to investigate the effect of elevated temperature on photorespiration; the results are shown in FIG. 9.

For all experiments, the slope of the growth curves during the linear growth phase was determined. As shown in Table 4, implementation of the BHAP in the ΔK-O background resulted in significantly increased slopes compared to the control strain in all cases. Taken together, these results confirm that implementation of the BHAP in the ΔK-O background permits faster growth of the engineered strain.

TABLE 4

Slopes derived from cyanobacterial growth curves. Suitable intervals of the growth curves were fitted with linear regression. The average slope ± standard deviation of three replicates is given, and it was compared whether the slopes of the two strains were significantly different in each experiment.

| Experiment | Interval for linear regression [h] | Slope ΔK-O | Slope ΔK-O + BHAP | Significant difference? |
|---|---|---|---|---|
| 30° C., I | 80-190 | 0.080 ± 0.002 | 0.096 ± 0.003 | Yes; p = 0.0004 |
| 30° C., II | 45-140 | 0.070 ± 0.002 | 0.086 ± 0.001 | Yes; p < 0.0001 |
| 30° C., III | 45-125 | 0.076 ± 0.002 | 0.092 ± 0.002 | Yes; p = 0.0002 |
| 37° C. | 90-190 | 0.062 ± 0.002 | 0.074 ± 0.001 | Yes; p < 0.0001 |

Similarly, the BHA pathway can be implemented in other bacteria, such as *Arthrospira platensis, Arthrospira maxima, Chlorella vulgaris, Dunaliella tertiolecta, Dunaliella salina, Tetraselmis maculata, Euglena gracilis, Scenedesmus obliquus, Cupriavidus necator, Chlamydomonas reinhardtii, Thalassiosira pseudonana, Nannochloropsis oculata, Skeletonema marinoi* and *Chaetoceros muelleri* in order to increase the growth rate of the engineered bacterium. Preliminary data which however have to be verified are also very promising for the organisms *Arthrospira platensis, Arthrospira maxima, Chlorella vulgaris, Dunaliella tertiolecta, Dunaliella salina, Tetraselmis maculata*, and *Euglena gracilis*.

Example 6—Crystal Structure Determination of BHAA and ISRed

Figure 10:
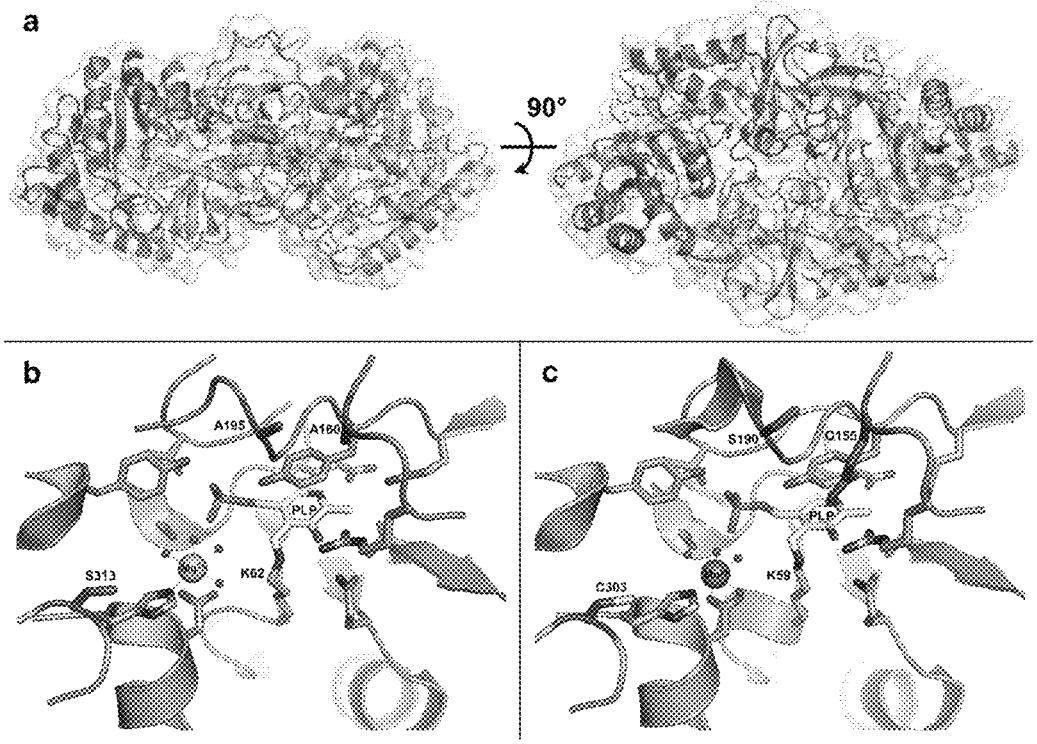
FIG. 10: shows the crystal structure of the β-hydroxyaspartate aldolase (BHAA). a, Cartoon representation of the β-hydroxyaspartate aldolase homodimer (PDB ID 6QKB) with superimposed protein surface (side view—left panel, top view—right panel). b, Active site of β-hydroxyaspartate aldolase with covalently bound pyridoxal phosphate (PLP). Active site residues highlighted (A160, A195, S313) are completely conserved only among β-hydroxyaspartate aldolases, but differ in D-threonine aldolases. c, Active site of D-threonine aldolase (PDB ID 4V15). The corresponding conserved residues among D-threonine aldolases (Q155, S190, C303) are highlighted as in b.
Figure 11:
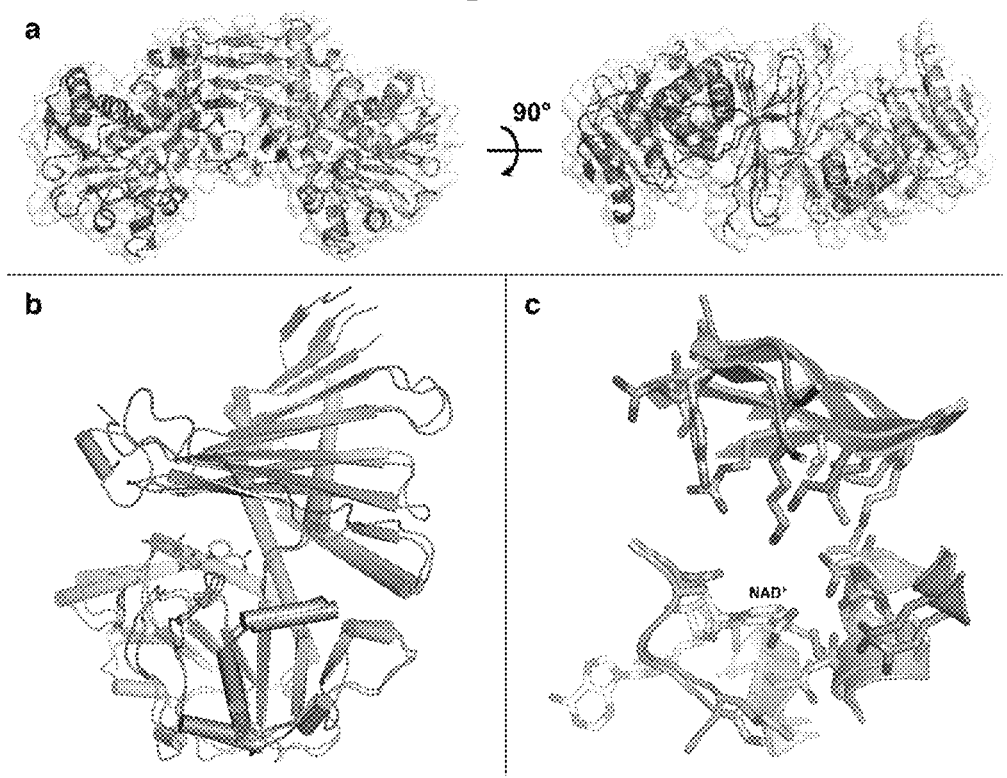
FIG. 11: shows the crystal structure of the iminosuccinate reductase (ISRed). a, Cartoon representation of the iminosuccinate reductase homodimer (PDB ID 6QKH) with superimposed protein surface (side view—left panel, top view—right panel). b, Superimposition of monomers of iminosuccinate reductase and L-alanine dehydrogenase (PDB ID 1OMO) with bound NAD$^+$. RMS of 1.287 Å over 241 Cα-atoms. c, Superimposition of the active sites of iminosuccinate reductase and L-alanine dehydrogenase. Although the binding of the nicotine amide moiety appears to be similar in both cases, the residues lining the active site from above differ substantially. These residues are located in the β-strands which also form the dimerization interface (see a for comparison) and are likely to be involved in the binding and orientation of the respective substrates above the nicotine amide moiety.

To determine the three-dimensional structure of key enzymes of the BHAP, we crystallized the BHAA and ISRed enzymes. The solved crystal structures of BHAA and ISRed have been deposited in the Protein Data Base (PDB; www.rcsb.org) under the PDB ID 6QKB and 6QKH. The X-ray diffraction data of both enzymes are shown in Table 5 below. Cartoon representations of the BHAA homodimer and the ISRed homodimer with superimposed protein surface are shown in FIGS. 10 and 11.

These crystal structures are used to determine amino acids that are crucial for function and specificity of these enzymes, which will enable the inventors to modify the active site of these enzymes to achieve better performance or altered specificities.

TABLE 5

X-ray diffraction data collection and model refinement statistics

| | β-hydroxyaspartate aldolase with bound pyridoxalphosphate (PDB ID 6QKB) | iminosuccinate reductase (PDB ID 6QKH) |
|---|---|---|
| Data collection | | |
| Space group | P $2_1 2_1 2_1$ | C 1 2 1 |
| Cell dimensions | | |
| a, b, c (Å) | 66.60, 75.25, 157.31 | 217.74, 46.63, 188.85 |
| α, β, γ (°) | 90.00, 90.00, 90.00 | 90.00, 94.42, 90.00 |
| Resolution (Å) | 29.03-1.70 (1.79-1.70) | 24.67-3.40 (3.58-3.40) |
| $R_{merge}$ | 0.134 (0.858) | 0.150 (0.849) |
| I/σI | 10.4 (1.9) | 5.8 (1.5) |
| $CC_{1/2}$ (%) | 99.7 (70.8) | 99.5 (52.5) |
| Completeness (%) | 99.8 (99.0) | 99.5 (99.9) |
| Redundancy | 6.7 (6.5) | 3.5 (3.6) |

TABLE 5-continued

X-ray diffraction data collection and model refinement statistics

| | β-hydroxyaspartate aldolase with bound pyridoxalphosphate (PDB ID 6QKB) | iminosuccinate reductase (PDB ID 6QKH) |
|---|---|---|
| Refinement | | |
| Resolution (Å) | 29.03-1.70 (1.74-1.70) | 24.67-3.40 (3.52-3.40) |
| No. unique reflections | 87194 (5909) | 26685 (2613) |
| $R_{work}/R_{free}$ | 0.1576/0.1765 | 0.2672/0.2818 |
| No. atoms | 6671 | 13403 |
| Protein | 5817 | 13403 |
| Ligands | 32 | NA |
| Water | 822 | NA |
| B-factors | | |
| Protein | 17.05 | 100.02 |
| Ligands | 23.66 | NA |
| Water | 31.58 | NA |
| R.m.s. deviations | | |
| Bond lengths (Å) | 0.006 | 0.004 |
| Bond angles (°) | 0.84 | 0.64 |

Number in parentheses indicate statistics for highest resolution shell. The structures were determined from single crystals.
NA - not applicable.

SEQUENCE LISTING (965 sequences)

SEQ ID NO: 1 - DNA, 963 bp, Paracoccus denitrificans DSM 413
  CDS (1)..(963): iminosuccinate reductase
atgctcgtcgtcgccgaaaaggaaatcgcgggtctgatgacccccgaggcggccttcgaggccatcgaggcggtcttcgcctcgatggcccggcgcaaggcatacaattttcccgtggtgcgcgaggccatcggccatgaggacgcgctctacggcttcaagggcggcttcgacgcctcggcgctggtgctggggctgaaggccggcggctactggcccaacaaccagaagcacaacctgatcaaccaccagtccaccgtgttcctgttcgacccggataccggccgggtctcggcggcggtaggcggcaacctgctgacggcgctgcgcaccgcggcggcctcggcggtgtcgatcaagtatctggcgcccaagggcgccaaggtgctgggcatgatcggcgccggccaccagtccgcgttccagatgcgggcggcggccaatgtgcatcggttcgaaaaggtcatcggctggaacccgcatcccgagatgctgtcgcgccttgccgataccgcggccgagctgggcctgcccttcgaggcggtcgaactggaccggcttggggccgaggccgacgtgatcgtctcgatcacctcgtccttctcgcctctgctgatgaacgagcatgtcaagggcccgacgcatatcgcggccatgggcaccgacaccaagggcaagcaagagctggatccggcgctggtcgcgcgcgcacggatcttcaccgacgaggtcgcgcagtcggtcagcatcggcgaatgccagcacgccatcgcggcgggtctgatccgcgaggatcaggtcggcgagcttggcgcggtggtcgcgggcgacgacccgggccgcggggatgccgaggtcacgatcttcgacggcaccggcgtcgggttgcaggacctggcggtcgcgcaagcggtcgtcgaactcgccaaacacaagggggtggcgcaagaggtcgagatctga

SEQ ID NO: 2 - protein, 320 aa, Paracoccus denitrificans DSM 413
MLVVAEKEIAGLMTPEAAFEAIEAVFASMARRKAYNFPVVREAIGHEDALYGFKGGFDASALVLGLKAGGYWPNNQKHNLINHQSTVFLFDPDTGRVSAAVGGNLLTALRTAAASAVSIKYLAPKGAKVLGMIGAGHQSAFQMRAAANVHRFEKVIGWNPHPEMLSRLADTAAELGLPFEAVELDRLGAEADVIVSITSSFSPLLMNEHVKGPTHIAAMGTDTKGKQELDPALVARARIFTDEVAQSVSIGECQHAIAAGLIREDQVGELGAVVAGDDPGRGDAEVTIFDGTGVGLQDLAVAQAVVELAKHKGVAQEVEI

SEQ ID NO: 3 - DNA, 1164 bp, Paracoccus denitrificans DSM 413
  CDS (1)..(1164): beta-hydroxyaspartate aldolase
atgaacgcgaaaacggatttctccggctacgaggtcggctatgacatccccgccctgcccggcatggacgagagcgagatccagacgccttgcctgatcctcgacctggacgcgctggagcgcaacatcaggaagatgggcgactacgccaaggcccacggcatgcgccaccgcagccacggcaagatgcacaagtcggtcgacgtgcagaagctgcaggagtcgctgggcggctcggtcggcgtctgctgccagaaggtcagcgaggccgaggcctttgcccgcggcggcatcaaggacgtgctggtcaccaacgaggtgcgcgagccggccaagatcgaccgcctggcccggctgcccaagaccggcgccacggtgacggtctgcgtcgacgacgtgcagaacatcgccgacctgtcggccgccgcgcagaagcacggcaccgagctgggcatcttcgtcgagatcgattgcggcgccggccgctgcggcgtgaccaccaaggaagccgtggtcgagatcgccaaggccgccgcggctgccccgaacctgaccttcaagggcatccaggcctatcagggcgcgatgcagcacatggacagcttcgaggaccgcaaggccaagctggacgccgccattgcccaggtgaaagaggccgtggacgcgctggaggccgagggcctggcccccgaattcgtctcgggcggcggcacgggttcctattatttcgaaagcaattctggtatttacaacgaattgcaatgcggctcctatgccttcatggatgccgattacggccgcatccacgatgccgagggcaagcgcatcgaccagggcgaatgggaaaacgcgctgttcatcctgacctcggtcatgtcgcatgccaagccgcacctggcggtggtcgatgccggcctcaaggcacagtcggtcgatagcggcctgcccttcgtctatggccgcgacgatgtgaaatacatcaagtgcagcgacgagcatggcgtggtcgaggacaaggacggcgtgctcaaggtcaacgacaagctgcggctggtgccgggccattgcgacccgacctgcaacgtccacgactggtatgtcggcgtgcggaacggcaaggtcgagacggtctggccggtctcggcgcgcggaaagggctactga

SEQ ID NO: 4 - protein, 387 aa, Paracoccus denitrificans DSM 413
MNAKTDFSGYEVGYDIPALPGMDESEIQTPCLILDLDALERNIRKMGDYAKAHGMRHRSHGKMHKSVDVQKLQESLGGSVGVCCQKVSEAEAFARGGIKDVLVTNEVREPAKIDRLARLPKTGATVTVCVDDVQNIADLSAAAQKHGTELGIFVEIDCGAGRCGVTTKEAVVEIAKAAAAAPNLTFKGIQAYQGAMQHMDSFEDRKAKLDAAIAQVKEAVDALEAEGLAPEFVSGGGTGSYYFESNSGIYNELQCGSYAFMDADYGRIHDAEGKRIDQGEWENALFILTSVMSHAKPHLAVVDAGLKAQSVDSGLPFVYGRDDVKYIKCSDEHGVVEDKDGVLKVNDKLRLVPGHCDPTCNVHDWYVGVRNGKVETVWPVSARGKGY

SEQ ID NO: 5 - DNA, 948 bp, Paracoccus denitrificans DSM 413
  CDS (1)..(948): beta-hydroxyaspartate dehydratase
atgtatatcccgacctatgaggacatgctggccgcgcatgagcggatcaagccgcatatccgccgcacgccgatccgcacctcggactatctgaacgagttgaccggcgcgcagctgttcttcaaatgcgagaacttccaggagccgggggccttcaaggtccgcggcgccaccaacgcggtcttcggcctcgacgatgcgcaggcggccaagggcgtcgcgacgcacagctcgggcaaccatgcctcgtgcctcagctacgccgccatgctgcgcggcattccctgcaacgtggtcatgccgcgcaccgcgccgcaggccaagaaggacacggtgcgccgctatggcggtgtcatcaccgaatgcgagccctcgaccagctcgcgcgaagagaccttcgccaaggtgcaggccgagaccggcggcgatttcgtccacccctataacgacccgcgcgtgatcgccggccagggcacctgcgccaaggaactggtcgagcaggtggacgggctcgacgcggtcgtggcccccatcggcggcggcggcatgatctcgggcacctgcctgacgctctcgacgctggcgcccgagaccagggtgatcgcggccgagcccgagcaggccgacgacgcctatcgcagcttcaaggccggctacatcatcgccgacgacgcgcccaagaccgtcgccgacgggctgctggtgccgctgaaggatctgacctggcatttcgtcaagaaccacgtcagcgagatctacaccgcctcggacgccgagatcgtggacgcgatgaagctgatctggaagcatctgcgcatcgtgatggagccctccagcgccgtgccgctggccaccatcctgaagaaccccgaagcctttgccggcaagcgcgtcggcgtcatcgtcaccggcggcaatgtcgatctcgacaagctgccgtggaactga

SEQ ID NO: 6 - protein, 315 aa, Paracoccus denitrificans DSM 413
MYIPTYEDMLAAHERIKPHIRRTPIRTSDYLNELTGAQLFFKCENFQEPGAFKVRGATNAVFGLDDAQAAKGVATHSSGNHASCLSYAAMLRGIPCNVVMPRTAPQAKKDTVRRYGGVITECEPSTSSREETFAKVQAETGGDFVHPYNDPRVIAGQGTCAKELVEQVDGLDAVVAPIGGGGMISGTCLTLSTLAPETRVIAAEPEQADDAYRSFKAGYIIADDAPKTVADGLLVPLKDLTWHFVKNHVSEIYTASDAEIVDAMKLIWKHLRIVMEPSSAVPLATILKNPEAFAGKRVGVIVTGGNVDLDKLPWN

SEQ ID NO: 7 - DNA, 1191 bp, Paracoccus denitrificans DSM 413
  CDS (1)..(1191): aspartate-glyoxylate aminotransferase
atgaccagccagaacccgatcttcattcccggcccgaccaacatccccgaggagatgcgcaaggccgtcgacatgcccaccatcgaccaccgctcgccggtgttcgggcgtatgctgcacccggcgctcgagggcgtgaagaaagtcctcaagaccacgcaggcgcaggtcttcctgttcccctcgaccggcaccggcggctgggaaacggcgatcaccaacacgctgtcgcccggcgacaaggtgctggcagcccgtaacggcatgttcagccatcgctggatcgacatgtgccagcgccacggccttgacgtgaccttcgtcgagaccccctggggcgagggcgtcccggccgaccgcttcgaagagatcctgaccgccgacaagggccacgagatccgcgtcgtcctggccacgcataacgagaccgcgaccggggtcaaatcggacatcgccgccgtccgccgcgcgctggacgccgcgaaacacccggcgctgctgttcgtggacggggtctcctccatcggttcgatggatttccgcatggacgaatggggcgtcgacatcgccgtcaccgggtcgcaaaagggcttcatgttgccgccgggcctggccatcgtcggcttctcgcccaaggcgatggaggcggtcgagaccgcgcgcctgccgcgcaccttcttcgacatccgcgacatggcgaccggctatgcccgcaacggctatccctatacgccgccggtcgggctgatcaacggcctgaacgccagctgcgagcgcatcctggccgaggggctggagaatgtctttgcccgccaccaccgcatcgccagcggcgtgcgcgccgcggtcgatgcctgggggctgaagctctgcgccgtccgccccgagctttactcggacagcgtcagcgccatccgcgtgcccgagggcttcgacgccaacctgatcgtcagccacgcgctggagacctatgacatggccttcggcaccggcctgggccaggtcgcgggcaaggtgttccgcatcggccacctgggcagcctgaccgacgccatggcgctgtccggcatcgccaccgccgagatggtgatggccgatctgggcctgccgatccagctgggctcgggcgtcgccgccgcgcaggaacattaccgccagaccactgccgccgcgcagaagaaagccgcctga

SEQ ID NO: 8 - protein, 396 aa, Paracoccus denitrificans DSM 413
MTSQNPIFIPGPTNIPEEMRKAVDMPTIDHRSPVFGRMLHPALEGVKKVLKTTQAQVFLFPSTGTGGWETAITNTLSPGDKVLAARNGMFSHRWIDMCQRHGLDVTFVETPWGEGVPADRFEEILTADKGHEIRVVLATHNETATGVKSDIAAVRRALDAAKHPALLFVDGVSSIGSMDFRMDEWGVDIAVTGSQKGFMLPPGLAIVGFSPKAMEAVETARLPRTFFDIRDMATGYARNGYPYTPPVGLINGLNASCERILAEGLENVFARHHRIASGVRAAVDAWGLKLCAVRPELYSDSVSAIRVPEGFDANLIVSHALETYDMAFGTGLGQVAGKVFRIGHLGSLTDAMALSGIATAEMVMADLGLPIQLGSGVAAAQEHYRQTTAAAQKKAA

SEQ ID NO: 9 - DNA, 840 bp, Paracoccus denitrificans DSM 413
  CDS (1)..(840): beta-hydroxyaspartate regulatory protein
atgtcggttcaaatccgcaaaaggggccgtccgaggggacgtgccggcggccttggcgccgaggattcgggcggcatccgggcgctggaccgggcgctggacatccttgacctgatcgcggtctccagcgggttgaccctgaccgagatcgcgcagcggctggacatggcgccttcgaccgtgcaccgggtgctggtgacgctggcggcgcgcggggtggcggaaagcgacagccagacgcaggcatggcatgtcgggccgacggcgttccggcacggctcggccttcatgcgccgctcgggcctggtcgagcgggcgcggccgcttctgcgccggctgatggaggtgacgggcgagacggcgaacctgggcatcctgaacggcgatgcggtcctgttcctaagccaggccgagacgcatgagacgatccgcgccttctttccgcccggcacgcgctcggcgctgcatgcctcggggatcggcaaggcgttgctggcccatgcccggcccctggacctgaagcggatgctgcgcgagatgcggctggagcggttcaccgacatgaccctgaccgatcccgcagcactggtcgaggatctcgtgcagatccgcgcccgcggctatgcgctggacaacgaggagcgcacgcccggcatgcgctgcatcgccgcgccgatcttcgaccttgccggcgaggcggcggcggggatctcggtttcggggccgacattgcgcatgtcggatgcccggctttccgccatgtccgatgcggtgatcgaggccgcgcgggagctgtccttcggcatggcgccgcgcaaggatgccggcgaaagagcctga

SEQ ID NO: 10 - protein, 279 aa, Paracoccus denitrificans DSM 413
MSVQIRKRGRPRGRAGGLGAEDSGGIRALDRALDILDLIAVSSGLTLTEIAQRLDMAPSTVHRVLVTLAARGVAESDSQTQAWHVGPTAFRHGSAFMRRSGLVERARPLLRRLMEVTGETANLGILNGDAVLFLSQAETHETIRAFFPPGTRSALHASGIGKALLAHARPLDLKRMLREMRLERFTDMTLTDPAALVEDLVQIRARGYALDNEERTPGMRCIAAPIFDLAGEAAAGISVSGPTLRMSDARLSAMSDAVIEAARELSFGMAPRKDAGERA

SEQ ID NO: 11 - DNA, 31 bp, Artificial Sequence
  synthetic sequence
  misc_feature (1)..(31): PCR Primer for iminosuccinate reductase polypeptide encoding gene
gacgcctcatatgctcgtcgtcgccgaaaag

SEQ ID NO: 12 - DNA, 31 bp, Artificial Sequence
  synthetic sequence
  misc_feature (1)..(31): PCR Primer for iminosuccinate reductase polypeptide encoding gene
gccactcctcgagtcagatctcgacctcttg

SEQ ID NO: 13 - DNA, 31 bp, Artificial Sequence
  synthetic sequence
  misc_feature (1)..(31): PCR primer for beta-hydroxyaspartate aldolase polypeptide encoding gene
gacgccgcatatgaacgcgaaaacggatttc

SEQ ID NO: 14 - DNA, 29 bp, Artificial Sequence
  synthetic sequence
  misc_feature (1)..(29): PCR primer for beta-hydroxyaspartate aldolase polypeptide encoding gene
gacacctggatcctcagtagccctttccg

SEQ ID NO: 15 - DNA, 31 bp, Artificial Sequence
  synthetic sequence
  misc_feature (1)..(31): PCR primer for beta-hydroxyaspartate dehydratase polypeptide encoding gene
gacgctgcatatgtatatcccgacctatgag

SEQ ID NO: 16 - DNA, 32 bp, Artificial Sequence
  synthetic sequence
  misc_feature (1)..(32): PCR primer for beta-hydroxyaspartate dehydratase polypeptide encoding gene
gacactcggatcctcagttccacggcagcttg

SEQ ID NO: 17 - DNA, 27 bp, Artificial Sequence
  synthetic sequence
  misc_feature (1)..(27): PCR primer for aspartate-glyoxylate aminotransferase polypeptide encoding gene
gccactacatatgaccagccagaaccc

SEQ ID NO: 18 - DNA, 32 bp, Artificial Sequence
  synthetic sequence
  misc_feature (1)..(32): PCR primer for aspartate-glyoxylate aminotransferase polypeptide encoding gene
gccactcggatcctcaggcggctttcttctgc

SEQ ID NO: 19 - DNA, 26 bp, Artificial Sequence
  synthetic sequence
  misc_feature (1)..(26): PCR primer for beta-hydroxyaspartate regulatory protein encoding gene
gccacatcatatgtcggttcaaatcc

SEQ ID NO: 20 - DNA, 34 bp, Artificial Sequence
  synthetic sequence
  misc_feature (1)..(34): PCR primer for beta-hydroxyaspartate regulatory protein encoding gene
gtcactcggatcctcaggctctttcgccggcatc

SEQ ID NO: 21 - DNA, 46 bp, Artificial Sequence
  synthetic sequence
  misc_feature (1)..(46): Upstream flanking region of the iminosuccinate reductase polypeptide encoding gene
ggtctgacaggtttaaactctagacacggcaccgagctgggcatct

SEQ ID NO: 22 - DNA, 36 bp, Artificial Sequence
  synthetic sequence
  misc_feature (1)..(36): Upstream flanking region of the iminosuccinate reductase polypeptide encoding gene
cggcacgggcatatgtcagtagccctttccgcgcgc

SEQ ID NO: 23 - DNA, 40 bp, Artificial Sequence
  synthetic sequence
  misc_feature (1)..(40): Downstream flanking region of the iminosuccinate reductase polypeptide encoding gene
aaagggctactgacatatgcccgtgccgctcgcgtcctga

SEQ ID NO: 24 - DNA, 51 bp, Artificial Sequence
  synthetic sequence
  misc_feature (1)..(51): Downstream flanking region of the iminosuccinate reductase polypeptide encoding gene
cttaaggctagcatgcatcctaggcggcatagcgtgcgatcaccaggatcg

SEQ ID NO: 25 - DNA, 46 bp, Artificial Sequence
  synthetic sequence
  misc_feature (1)..(46): Upstream flanking region of the beta-hydroxyaspartate aldolase polypeptide encoding gene
ggtctgacaggtttaaactctagacgctcgggcaaccatgcctcgt

SEQ ID NO: 26 - DNA, 41 bp, Artificial Sequence
  synthetic sequence
  misc_feature (1)..(41): Upstream flanking region of the beta-hydroxyaspartate aldolase polypeptide encoding gene
cctttccgcgcatatgggggctctcctcaattctggttcag

SEQ ID NO: 27 - DNA, 43 bp, Artificial Sequence
  synthetic sequence
  misc_feature (1)..(43): Downstream flanking region of the beta-hydroxyaspartate aldolase polypeptide encoding gene
tgaggagagcccccatatgcgcggaaagggctactgatgctcg

SEQ ID NO: 28 - DNA, 46 bp, Artificial Sequence
  synthetic sequence
  misc_feature (1)..(46): Downstream flanking region of the beta-hydroxyaspartate aldolase polypeptide encoding gene
cttaaggctagcatgcatcctaggcggtgaagatccgtgcgcgcgc

SEQ ID NO: 29 - DNA, 46 bp, Artificial Sequence
  synthetic sequence
  misc_feature (1)..(46): Upstream flanking region of the beta-hydroxyaspartate dehydratase polypeptide encoding gene
ggtctgacaggtttaaactctagacgcgctggacgccgcgaaacac

SEQ ID NO: 30 - DNA, 40 bp, Artificial Sequence
  synthetic sequence
  misc_feature (1)..(40): Upstream flanking region of the beta-hydroxyaspartate dehydratase polypeptide encoding gene
ctcaattctggtcatatgggcgtccttcatcctcaggcgg

SEQ ID NO: 31 - DNA, 49 bp, Artificial Sequence
  synthetic sequence
  misc_feature (1)..(49): Downstream flanking region of the beta-hydroxyaspartate dehydratase polypeptide encoding gene
gatgaaggacgcccatatgaccagaattgaggagagccccatgaacgcg

SEQ ID NO: 32 - DNA, 46 bp, Artificial Sequence
  synthetic sequence
  misc_feature (1)..(46): Downstream flanking region of the beta-hydroxyaspartate dehydratase polypeptide encoding gene
cttaaggctagcatgcatcctaggcccgtgccgccgcccgagacga

SEQ ID NO: 33 - DNA, 46 bp, Artificial Sequence
  synthetic sequence
  misc_feature (1)..(46): Upstream flanking region of the aspartate-glyoxylate aminotransferase polypeptide encoding gene
ggtctgacaggtttaaactctagaccgctccagccgcatctcgcgc

SEQ ID NO: 34 - DNA, 42 bp, Artificial Sequence
  synthetic sequence
  misc_feature (1)..(42): Upstream flanking region of the aspartate-glyoxylate aminotransferase polypeptide encoding gene
gtccttcatcccatatgggcaattcctcctgcgcttgtggac

SEQ ID NO: 35 - DNA, 43 bp, Artificial Sequence
  synthetic sequence
  misc_feature (1)..(43): Downstream flanking region of the aspartate-glyoxylate aminotransferase polypeptide encoding gene
aggaggaattgcccatatgggatgaaggacgccatgtatatcc

SEQ ID NO: 36 - DNA, 46 bp, Artificial Sequence
  synthetic sequence
  misc_feature (1)..(46): Downstream flanking region of the aspartate-glyoxylate aminotransferase polypeptide encoding gene
cttaaggctagcatgcatcctaggcggtcagatccttcagcggcac

SEQ ID NO: 37 - DNA, 47 bp, Artificial Sequence
  synthetic sequence
  misc_feature (1)..(47): Upstream flanking region of the 2-phosphoglycolate phosphatase polypeptide encoding gene
ggtctgacaggtttaaactctagacgaacatcaaccgccaaccaatc

SEQ ID NO: 38 - DNA, 38 bp, Artificial Sequence
  synthetic sequence
  misc_feature (1)..(38): Upstream flanking region of the 2-phosphoglycolate phosphatase polypeptide encoding gene
ccggacggagcatatgtcacgccttccatttgatcgag

SEQ ID NO: 39 - DNA, 40 bp, Artificial Sequence
  synthetic sequence
  misc_feature (1)..(40): Downstream flanking region of the 2-phosphoglycolate phosphatase polypeptide encoding gene
atggaaggcgtgacatatgctccgtccgggcgcggcaacg

SEQ ID NO: 40 - DNA, 52 bp, Artificial Sequence
  synthetic sequence
  misc_feature (1)..(52): Downstream flanking region of the 2-phosphoglycolate phosphatase polypeptide encoding gene
cttaaggctagcatgcatcctaggcaggcccagaaggcccaggatgaacagc

SEQ ID NO: 41 - DNA, 22 bp, Artificial Sequence
  synthetic sequence
  misc_feature (1)..(22): Primer Pbha_rev-dye
ggaatgaagatcgggttctggc

SEQ ID NO: 42 - DNA, 21 bp, Artificial Sequence
  synthetic sequence
  misc_feature (1)..(21): Primer Pbha_fw
cccttttgcggatttgaaccg

SEQ ID NO: 43 - DNA, 1008 bp, Artificial Sequence
  synthetic sequence
  misc_feature (1)..(1008): nucleotide sequence encoding for the immunosuccinate reductase enzyme, codon-optimized for expression in Synecchococcus elongatus PCC7942, together with upstream and downstream flanking regions
agatctatgctagtggtggccgaaaaggagattgccggtctaatgacgcccgaggcggcctttgaagcgattgaagcggtttttgcttcgatggcgcgtcgcaaagcgtacaacttccctgtagtccgggaagctatcgggcatgaagacgcgctttacgggtttaaaggtgggtttgatgcctctgcgttagttctcggactaaaagcgggtggttattggcccaataatcagaagcacaacctcattaaccaccaatcaaccgtctttttattcgaccccgacaccggccgcgtcagtgccgcggttggaggcaacctactgacggcgttgcgtacggctgcggcaagcgccgtttcgattaaatatttagcacccaagggggcaaaggttctggggatgattggtgcgggccatcaatccgcattccaaatgagagcggcagcgaatgtgcacaggttcgagaaagtcattggttggaacccgcatccggaaatgttgtcccgcctggctgacacagctgcggagctcggcctgccctttgaagcagttgaactcgaccgcctcggagctgaagcggacgtgattgttagcattacgagttcgttcagcccactgctaatgaatgaacatgtgaagggcccgacgcatattgccgccatgggtacagacaccaaagggaagcaagagttagatccggctcttgttgctcgtgctcgcatttttactgacgaagtagcccaaagcgtgtccatcggcgaatgtcagcatgctattgccgctggcttaattcgggaggatcaagtgggtgaattgggcgctgtcgtggccggcgatgatccaggccgcggcgatgccgaagtgacaatcttcgatggcacaggcgtgggacttcaggacttggcagtggctcaggccgtggtcgaattggccaaacataaaggggtcgctcaggaggtcgaaatctagcccgtgccgctcgcgtcctgaacaggatcctaactcgag

SEQ ID NO: 44 - DNA, 1206 bp, Artificial Sequence
  synthetic sequence
  misc_feature (1)..(1206): nucleotide sequence encoding for the beta-hydroxyaspartate aldolase enzyme, codon-optimized for expression in Synecchococcus elongatus PCC7942, together with upstream and downstream flanking regions
agatctaccagaattgaggagagccccatgaatgcgaaaacagacttcagtggctacgaggtcggctatgatattcccgctctcccaggaatggatgagtctgagatccagactccttgtcttatcctggaccttgacgcgttggagagaaacattcgcaagatgggggactatgctaaggcccacggaatgcgacaccgttcgcacggtaagatgcataagtctgtcgacgtgcagaaactccaggaaagccttgggggtagcgtgggggtctgttgccaaaaggtttcggaagccgaggcctttgcccgaggcggtattaaggacgttctggtaacgaacgaagtacgtgaaccggccaagattgatcggttggcaagactacctaagactggtgctacggttactgtgtgcgtcgacgacgtgcaaaacattgctgacctctcggctgcggctcagaaacacggaacggagttgggtatctttgttgagatcgactgcggcgccggacgctgcggagttaccacgaaggaggcggtcgtcgagatcgcgaaggccgctgcggctgcgcccaacctgaccttcaaaggtattcaggcttaccaaggcgcaatgcaacacatggattcatttgaagatcgcaaagcaaaattagacgccgcaatcgcgcaggtcaaggaggccgtcgatgccctagaggccgaagggctcgccccagaatttgtttcgggcgggggcaccgggtcatattactttgaatcgaactccggcatttataacgaattacagtgcgggagttacgctttcatggacgctgattacgggcgcatccatgatgcggaaggcaaacgcatcgatcagggagaatgggaaaacgcgctctttatcctgactagcgttatgagtcatgcaaaaccgcatctagcggtagttgatgcaggcctgaaggcacaaagtgttgatagcggtctgccgttcgtgtatggccgtgatgacgttaaatatatcaaatgcagcgatgaacatggcgtcgtggaagataaggatggtgtgttgaaagtcaatgataaactgaggctggtgccgggtcactgtgatcccacctgtaatgtccacgattggtatgtgggagtccgcaatggcaaagtggaaaccgtgtggcccgtgtccgcccgcggcaagggttactagggatcctaactcgag

SEQ ID NO: 45 - DNA, 1004 bp, Artificial Sequence
  synthetic sequence
  misc_feature (1)..(1004): nucleotide sequence encoding for the beta-hydroxyaspartate dehydratase enzyme, codon-optimized for expression in Synecchococcus elongatus PCC7942, together with upstream and downstream flanking regions
agatctggatgaaggacgccatgtacattccgacctatgaggacatgcttgcggctcatgaacgcattaaaccgcatatccgacgcacgcccattcgcacgagtgattacctcaacgagttgaccggtgcccaactgttctttaagtgcgaaaattttcaggagcctggcgcttttaaagtgcggggggccacgaacgccgtatttggcctcgacgacgcgcaagcagctaagggagtagctacacatagttcggggaatcatgcttcctgcctgtcttacgctgcaatgttacgaggaatcccctgtaacgtcgttatgccccgcacagccccacaggcaaaaaaagacacagttcgcagatacggtggtgtgattactgagtgtgagcctagcacctctagccgcgaggaaaccttcgccaaggtccaggctgaaactggcggtgacttcgtacacccctacaatgaccctagggtaattgctggacaggggacttgtgctaaagaattggttgaacaagtcgatggcctagatgccgtggtggcgcctatcggcggcggggggatgatttcggggacttgtttaacgctttctacattagcccctgaaacccgtgttattgcggcagaaccggaacaagcggatgatgcgtatcgtagttttaaggcaggttacatcattgctgatgacgcccccaagacggtggcggatggcttgctggttccactgaaggatcttacttggcacttcgtcaagaatcacgtcagcgaaatctataccgcctcagatgccgaaatcgtggatgccatgaagctgatctggaagcacctgcggatcgtgatggaacccagctccgccgttccgctggccaccatcctcaaaaacccagaagcgtttgccggtaaacgggtgggcgtcatcgtcaccggcggcaatgtcgatctcgataaattgccgtggaactagaccagaattgaggagagccccggatcctaactcgag

SEQ ID NO: 46 - DNA, 1256 bp, Artificial Sequence
  synthetic sequence
  misc_feature (1)..(1256): nucleotide sequence encoding for the aspartate glyoxylate aminotransferase enzyme, codon-optimized for expression in Synecchococcus elongatus PCC7942, together with upstream and downstream flanking regions
agatctgcttggtccacaagcgcaggaggaattgccatgacctcccaaaatccaatttttattccaggcccaacgaatattcccgaggaaatgcgaaaagcagtggatatgcccaccattgatcacagatcccccgtcttcggccgaatgttacaccctgctctagaaggggtgaaaaaagtcctaaagactactcaagcacaggtattcctttttcctagcacggggacgggggggtgggagactgccatcacaaacacattgagcccaggagataaagtcttagcggctcgaaacggtatgttttctcaccgttggatcgatatgtgccagcgtcacggccttgatgtcacattcgtagagaccccttggggtgagggtgttcccgccgatcgctttgaagagatcctgaccgcagacaaagggcatgaaatccgcgtggtcctcgctacacacaacgagactgcgacgggtgtgaagtcggatattgcggcagtccggcgggctctggacgcagcaaaacacccggctctgctgttcgttgacggagtctcaagtattggcagtatggattttcgcatggacgagtggggcgttgacatcgcagtcactggcagccaaaaaggttttatgctcccgcctggtctcgctatcgtggggtttagccccaaggcaatggaggcggttgagacggcccgtctaccgcgtacctttttcgacatccgggacatggctaccggctacgctcgcaacggatatccgtacaccccgcccgtgggactgatcaatggactcaacgcatcgtgcgaacgcatcttggcggaagggttggaaaatgttttcgcgcgccatcatcgcattgctagtggcgttcgcgcggcggtggatgcgtggggtctgaagctctgtgctgtccggccggaactgtatagtgattctgtctcagctatccgcgtccccgaaggtttcgatgctaatctcatcgtgagccatgcgctcgaaacctacgatatggcgttcggcaccggcttgggccaagtggcgggtaaggtgtttcggattggccatttgggcagcctgacggatgcgatggccctgtcgggcattgccacggccgaaatggttatggccgatctgggcttgccgattcaactgggctcgggcgtggccgccgcccaggaacattatcgccagaccacggccgccgcccagaagaaggccgcctagggatgaaggacgccggatcctaactcgag

SEQ ID NO: 47 - DNA, 1172 bp, Artificial Sequence
  synthetic sequence
  misc_feature (1)..(1172): nucleotide sequence encoding for the beta-hydroxyaspartate regulatory protein, codon-optimized for expression in Synecchococcus elongatus PCC7942, together with upstream and downstream flanking regions
agatctggcaattcctcctgcgcttgtggaccaagctacgttttgctgtccattgatgcaatttttctgaaaaatatttcgcaatcgcggaaaaatgacctaaagtgtcgtggaatcagatcgttgctcttttccaaagccaaagagtgattttcaacaaactcagaaagttgtcgaaaggaaaaattgaatgtcagtacagattcggaagcgcgggcgcccacgaggtcgtgctggggggctcggagccgaagattcgggtggtatccgggcactggaccgcgctctggacattctggacttgattgcagtgagcagtggcctgactctcactgaaatcgctcaacgcctagatatggcccctagcacggtccaccgcgtgcttgtgactctggcagcgcgcggcgttgcggagagtgactcacaaacgcaggcatggcatgtgggacctactgcgtttcgacacggctcggcattcatgcgccgcagtggcttggttgagagagctcgcccgttgttgcgccggctgatggaagtcacgggagagacggctaatctcgggatactaaacggcgacgcagtattattcctttctcaagcagagacacatgagaccattcgggccttctttcccccgggcacacgctccgccctgcatgcttcgggcatcggtaaggctttactggcccacgctagaccgcttgacctcaaacgaatgttgcgagaaatgcggttggaacgctttacagacatgaccctcaccgacccagccgcgttggtcgaggacctggttcagatccgcgcgcgtggatacgcactcgacaacgaagaacggacccccggtatgcgttgcattgcggctcccatcttcgatctggccggcgaagccgcagccggcatcagtgtcagcggccccaccctccggatgtcggatgctcggctgagcgcgatgtcagatgcggttatcgaggctgctcgtgaactctcttttgggatggcaccgcgcaaagatgccggggaacgtgcataattcgtctaaacttgaccaggacatgcccggctattcaggggagattgccgggattcgcgggtgatttgtatattaaccgcagattcacgttcagttcacgcggcccatcctagcttcggtgcagcatggatcctaactcgag

SEQ ID NO: 48 - DNA, 422 bp, Artificial Sequence
  synthetic sequence
  misc_feature (1)..(422): nucleotide sequence pLavUV_bb
ccaccaggtcaacgatgagggactggttgatcggtctagtcatcaaataaaacgaaaggctcagtcgaaagactgggcctttcgttttatctgttgtttgtcggtccatgggaacgctctcctgagtaggacaaatccgccgggagcggatttgaacgttgcgaagcaacggcccggagggtggcgggcaggacgcccgccataaactgccaggcatcaaattaagcagaaggccatcctgacggatggcctttttgcgtttctactctagtttcgaattgtgagcgctcacaatttcgaaaccccaggctttacactttatgcttccggctcgtataatgtgtggaattgtgagcggataacaatttctagagaattccacacaggagaagatctcatatgggatcctaactcgagggatc

SEQ ID NO: 49 - DNA, 312 bp, Artificial Sequence
  synthetic sequence
  misc_feature (1)..(312): nucleotide sequence pCpt_bb
ggtccatgggaacgctctcctgagtaggacaaatccgccgggagcggatttgaacgttgcgaagcaacggcccggagggtggcgggcaggacgcccgccataaactgccaggcatcaaattaagcagaaggccatcctgacggatggcctttttgcgtttctactctattaacaaaaaagcaggaataaaattaacatgatgtaacagacataagtcccatcaccgttgtataatgttaactgtgggattgcaaaagtctagagaattccacacaggagaagatctcatatgggatcctaactcgagggatc

SEQ ID NO: 50 - DNA, 46 bp, Artificial Sequence
  synthetic sequence
  misc_feature (1)..(46): PCR primer for the iminosuccinate reductase polypeptide encoding gene
caagggttactagaccagaattaggagaagatctatgctagtggtg

SEQ ID NO: 51 - DNA, 46 bp, Artificial Sequence
  synthetic sequence
  misc_feature (1)..(46): PCR primer for the iminosuccinate reductase polypeptide encoding gene
tccctcgagttaggatcccatatgactagatttcgacctcctgagc

SEQ ID NO: 52 - DNA, 53 bp, Artificial Sequence
  synthetic sequence
  misc_feature (1)..(53): PCR primer for the beta-hydroxyaspartate aldolase polypeptide encoding gene
gtctagagaattccacacaggagaagatctatgaatgcgaaaacagacttcag

SEQ ID NO: 53 - DNA, 34 bp, Artificial Sequence
  synthetic sequence
  misc_feature (1)..(34): PCR primer for the beta-hydroxyaspartate aldolase polypeptide encoding gene
tcctaattctggtctagtaacccttgccgcgggc

SEQ ID NO: 54 - DNA, 49 bp, Artificial Sequence
  synthetic sequence
  misc_feature (1)..(49): PCR primer for the beta-hydroxyaspartate dehydratase polypeptide encoding gene
gaaggccgcctagaccagaattaggagaagatctatgtacattccgacc

SEQ ID NO: 55 - DNA, 46 bp, Artificial Sequence
  synthetic sequence
  misc_feature (1)..(46): PCR primer for the beta-hydroxyaspartate dehydratase polypeptide encoding gene
ggactcgagttaggatcccatatgactagttccacggcaatttatc

SEQ ID NO: 56 - DNA, 58 bp, Artificial Sequence
  synthetic sequence
  misc_feature (1)..(58): PCR primer for the aspartate glyoxylate aminotransferase polypeptide encoding gene
gtctagagaattccacacaggagaagatctatgacctcccaaaatccaatttttattc

SEQ ID NO: 57 - DNA, 34 bp, Artificial Sequence
  synthetic sequence
  misc_feature (1)..(34): PCR primer for the aspartate glyoxylate aminotransferase polypeptide encoding gene
tcctaattctggtctaggcggccttcttctgggc

SEQ ID NO: 58 - DNA, 41 bp, Artificial Sequence
  synthetic sequence
  misc_feature (1)..(41): PCR Primer for plasmid pNS3_A
gttgccgtgacgccgactgtctggagtatctagtcgcgttg

SEQ ID NO: 59 - DNA, 65 bp, Artificial Sequence
  synthetic sequence
  misc_feature (1)..(65): PCR Primer for plasmid pSyn6_A
gcgaagtcgaggcatttctgtcctggctggctattaagcttcttctaatccagtgtagacagtag

SEQ ID NO: 60 - DNA, 26 bp, Artificial Sequence
  synthetic sequence
  misc_feature (1)..(26): PCR Primer for plasmid pNS3_cpt_bb
tataagcttcaacgatgagggactgg

SEQ ID NO: 61 - DNA, 20 bp, Artificial Sequence
  synthetic sequence
  misc_feature (1)..(20): PCR Primer for plasmid pNS3_cpt_bb
cgatccctcgagttaggatc

SEQ ID NO: 62 - DNA, 684 bp, Paracoccus denitrificans DSM 413
  CDS (1)..(684): Phosphoglycolate phosphatase
atgaacatctgctttgccccctgccccgtggttttcgatcttgacggcacgctgatcgacagcgtgcccgacatccatgcctgcgtgaacgcggtcttgcgcctgcacggcgtggctccgctgacgctcgatcaggtgcgcggcttcgtcggcggcggcgtcgatctgctgtggcggcgggtgatcggcacgaccgggctgccggccgaggcgcatcgcgacctggtcgcctcgttcatgacccgctatcacgacgccaccggcctgacccggctttatcccaatgtcaccgaggcgttggggatactggccgaccgcggctatccgctggggctctgcaccaacaagccgctggggccgacgcgggcgatcctggaccatttcggcatcgcgcacctgttcggcatggtgatcggcggcgattccctgccccagcgcaagcccgatccggcgccgctgcgcgcggccttcgccgggctgggcgccgatcccctgaagccgcgcggggtctatgtcggcgacagcgaattcgacgaggaatgcgccagcaataccggcgtgcccttcctgctgttcacccacggctatcgcaagactccggtcgagcagatggcgcatcatggcacgttcgacgatttcgcccacctgcccctgctggtcgaggagacttcggccgtcggctag

SEQ ID NO: 63 - protein, 227 aa, Paracoccus denitrificans DSM 413
MNICFAPCPVVFDLDGTLIDSVPDIHACVNAVLRLHGVAPLTLDQVRGFVGGGVDLLWRRVIGTTGLPAEAHRDLVASFMTRYHDATGLTRLYPNVTEALGILADRGYPLGLCTNKPLGPTRAILDHFGIAHLFGMVIGGDSLPQRKPDPAPLRAAFAGLGADPLKPRGVYVGDSEFDEECASNTGVPFLLFTHGYRKTPVEQMAHHGTFDDFAHLPLLVEETSAVG

SEQ ID NO: 64 - DNA, 2237 bp, Artificial Sequence
  synthetic sequence
  misc_feature (1)..(2237): nucleotide sequence (full sequence, including introns and exons) encoding Glyoxylate reductase from Arabidopsis thaliana
tcaaaacccaaaatccctcttatttcaaacacgtggcgaaatcctgttcgttcataactggcagttagagatgcaaacagaatcaaactgtagggagtaaactgtaaatacttccttttcaaagtaagtgtatttgatgataatggttctctgattagaaaaggctccggctttatcattctcagaccatcatcactaagcagtaagtaagcactataatcgcagaagatagataaaatggaagtagggtttctgggtttgggaatcatgggaaaagccatgtcaatgaatctattgaagaatggattcaaagtcactgtatggaacagaacactctccaaggtaattttttttttttttttgtctttgattgtgttttggtattatggttttctgatttagttttagttgttcagatctgataaagtcggaaactttttgagtaatttaatgcaattttgggaatttttgatgattgtgacagtgtgatgagcttgtggagcatggtgcatcagtatgtgagagtccagctgaagtaatcaagaaatgcaaatacactattgctatgctctctgatccttgtgctgctctttcggtatttgaaatccttttttgcttcttttgtgtgtgttttagcattggtgatgaatgatatgaagtagttgtttgattaggttgttttcgataaaggcggtgttttggagcagatatgtgaaggaaaaggttatatcgatatgtcgactgttgatgcagagacttctttgaagatcaatgaggttgaatcttttgtactttagatgctgatgataagattagaagaaggttgattagtttgattgagctgtgttgcgcattggtaggcaatcaccgggaagggtggtcggttcgtagaaggtccggtttcaggtagcaaaaagccagctgaagatggccaactcattatccttgctgctggtgacaaggtacaactcaaaactgtacttatggattgattgatagatctcaagaactgttttagttggacttagtaggaaggagctctcgatgtgcggctataatccgtttgtgttttaatccttttttgtaaggcactctttgaggaatcaatcccagcttttgatgtcttggggaagagatcgttttacttgggacaagttggaaacggagctaaaatgaagctaatagtgaacatgataatgggaaggtgaatgtcccgtctcttttacaattactaccattagtagtaggaatggaacatggcttcatgatcttattgtttttcgtctgatacagcatgatgaatgcattctctgaggggcttgtattggctgacaagagtggacttagctctgacactcttttggatattctggtgaggtgatcaaacttttgcaagctctgaaataatggtgttggtttgaatcggtttctgctatgggcaggatctgggagcaatgactaacccgatgttcaaggggaaaggaccttcaatgaacaagagtagttacccaccagcatttccattgaaacatcagcagaaagacatgaggctagctcttgctcttggcgatgaaaacgcggtttccatgcctgtagccgcggctgcaaacgaggtcagttagttagttagttactcagagacaataacatattggctctccctcctctagattggtttcttagcttgaatcttaaaatatatgtttcggttctcgacaggcttttaagaaggcgagaagcttgggactaggagatctcgacttctctgctgtgattgaagctgtgaaattctcccgcgaatagcaaactgtttcaaaacatccactcatttggattggctgagatactgaaatcattgttatcttcccaaatagagatttactcatttggccaaacacacattttactccttcaccaaataaaaagtcttaaccacatatccagaaacgttcatagagttgcaaccttacgtttcaactactttatggctagttcactcgatattggtccagaggtagatcaaattgattgaaacagaaccaataaaatagagcaaagtttatttgaagttggtcactgttaaggttatatgaaacaaaggaagcaaaaaagaacccgtagatgagaagatcaaagaaataacattgcatcaagatggtcaagagaaatgttcctatggattatagacaaacgaggagaggaggagaccatttcagtagaaaattggatttcgttgg

SEQ ID NO: 65 - protein, 289 aa, Arabidopsis thaliana
  PEPTIDE (1)..(289): Glyoxylate reductase
MEVGFLGLGIMGKAMSMNLLKNGFKVTVWNRTLSKCDELVEHGASVCESPAEVIKKCKYTIAMLSDPCAALSVVFDKGGVLEQICEGKGYIDMSTVDAETSLKINEAITGKGGRFVEGPVSGSKKPAEDGQLIILAAGDKALFEESIPAFDVLGKRSFYLGQVGNGAKMKLIVNMIMGSMMNAFSEGLVLADKSGLSSDTLLDILDLGAMTNPMFKGKGPSMNKSSYPPAFPLKHQQKDMRLALALGDENAVSMPVAAAANEAFKKARSLGLGDLDFSAVIEAVKFSRE

SEQ ID NO: 66 - protein, 292 aa, Silicibacter pomeroyi DSS-3
  MISC_FEATURE (1)..(292): Megaplasmid
MAAGTARNFPVIREAIGHADALYGFKSGFDRQALNLGLKSGGYWPGNADKGLTNHQSTVFLFDADTGRCQAVVGGNLLTALRTAAASSVSIKHLARQDAKVIGMIGAGHQAKFQLRAALEQRNFEKVIGWNLHPEMLVNLQEVADEAGLPFEAVELDGMREADVIITITSSFDAILKADQVSPGTHIACMGTDTKGKQEVDPQLLVMADVFTDEVAQSISIGEAQHAVAHGLIQAADVAQIGAVINGTNPGRTSDAQITLFDGTGVGLQDLAVAATVVERARAAGAGTEIAF

SEQ ID NO: 67 - protein, 321 aa, Silicibacter sp. TM1040
MYIVPERVIADLMTREAAFDAVEKVFAAMAAEDAYNFPVVREAIGHEDALYGFKGGFDRAGLTLGLKAGGYWPHNLEKRGQINHQSTVFLFDPDTGKAHAMVGGNLLTALRTAAASSVSIKHLARDDAKVIGMIGAGHQATFQLRAALEQRNFEKVIGWNLHPEMLPNIEAVAAEAGLPFEAVELDGMRAADVIISITSSFEASLMADHVSPGTHIACMGTDTKGKQEVDPALLVRAEVFTDEVAQSVGIGEAQHAVAQGLIEAADLTQLGAVINGAHPGRSTDDQITLFDGTGVGLQDLAVAARVVELAVTQGIAMEVDF

SEQ ID NO: 68 - protein, 321 aa, Loktanella vestfoldensis SKA53
MIIVPEKEIAGLMTRADAYNAVEQVFASMSSGRAYNFPVIREAIGHADALYGFKSGFDRDGLALGLKSGGYWPGNEANGLTNHQSTVFLFDADTGKCRAIVGGNLLTALRTAAASAVSINHLARKDASVLGMIGAGHQSVFQLRAAVEQRSFDKIIGWNYHPEMLQRLAAVAAELGIPFEAVSLAQLGAEADVIISITSAFAPSLLDIHVRPGTHIACMGTDTKGKQELEAAVLARATVFTDEVAQAVTIGEAQHAIAAGLITQDAIHEMGAVVNGTHPGRTSPDEITVFDGTGVGLQDLAVASAVVDLAVAKGVATTVEF

SEQ ID NO: 69 - protein, 320 aa, Paracoccus denitrificans PD1222; identical to SEQ ID NO: 2
  MISC_FEATURE (1)..(320): chromosome 2

SEQ ID NO: 70 - protein, 325 aa, Roseobacter denitrificans OCh 114
MSKGLLIVGEDICAEVVSSADAFTAVEAVFGAMAKGDAYNFPVIREAIGYADALYGFKSGFDKAGKTLGVKSGGYWPGNMDKGLTNHQSTIFLFDPDTGMLEALVGGNYLTAVRTAASSSVSIAHLARKDAKVLGMVGAGHQSTFQLRAAAEQRDFEKVVAWNPHPDMLPRLGAVAEELGLAFEAVTQEELGAQADVIITITSAFEPLLMKDWIKPGTHIACMGTDTKGKQEVDPELLVSATVFADEIAQSVTIGEAQHAVASGRLSDAEITPIGAVINGTHAGRSSDQQITLFDGTGVGLQDLAVASVAAREAESRGKATRIAL

SEQ ID NO: 71 - protein, 321 aa, Ahrensia sp. R2A130
  MISC_FEATURE (1)..(321): contig00014
MIIVPEKEIGGLVTREAAFDAVESVFAAMASGDAYNFPVIREAIGHVDALYGFKGGFDKAGMSLGLKAGGYWPNNLDTKGIINHQSTVFLFDPDTGQVSAMVGGNLLTALRTAAASSVSIKHLARKDAKVLGMIGAGHQAKFQLRTALEHRDFEKVIGWNLHPEMLPNLEEVAAEAGLPFEAVELSGMTEADVIITITSSFDATMMGDHVAPGTHVACMGTDTKGKQEVGVDLIAKATLFADEIAQSISIGECQHAIADGSIKEADITPIGAVINGTHTGRMSDDEITLFDGTGVGLQDLAVASAAVVLAKAQGKAIEVEL

SEQ ID NO: 72 - protein, 330 aa, Dinoroseobacter shibae DFL-12
MLQKPDTDGLVIVTEEICQKVIDRDLAFAAVRDVFGAMARGDAYNFPVIREAIGHEDALYGFKSGFDKAGMVLGVKAGGYWPNNMAKGIINHQSTVFLFDPDTGKLKALVGGNYLTAIRTAASSAVSIDQLARKDAKVLGMVGAGHQSTFQLRAAVEQRDFEKVVCWNPHPDMIPNLGKVAAEIGIPFEAVSREELGAQSDVIITITSAFEPLIEAGYIKPGTHLACMGTDTKGKQEVAAELVAKATLFTDEVAQSTTIGETQHAIASGAITQDDVTPIGKVINGDHPGRTSDDEITLFDGTGVGLQDLAVAAVAAEQAVATGAATRVSL

SEQ ID NO: 73 - protein, 321 aa, Octadecabacter arcticus 238
MYIVPESAIADILTRPDAFNAVEQVFAAMSAGVAYNFPVIREAIGHEEALYGFKGGFDGKGMSLGLKAGGYWPHNLEKRGIINHQSTVFLFDPDTGKVAAMVGGNLLTALRTAAASSVSIKHLARKDSKVMGMIGAGHQAKFQLRHALETHSFEKVIGWNYHPEMLPSLAEVAAEFDLPFEAVTLEGMTEADVVISMTSSFNPIFGAAHISDGTHIACMGTDTIGKQECETDLIVKATVFTDEVAQSVTLGETQHAVSAGLKSRDDIFELGAVINGTHAGRTSDREITLFDGTGVGLQDLAVAASIVEIAKAKGIGMDVDF

SEQ ID NO: 74 - protein, 321 aa, Artificial Sequence
  synthetic peptide
  MISC_FEATURE (1)..(321): pDaep_A276
MYIVPEKAVADLVTREASFDAVEKVFAAMASGDAYNFPVVREAIGHEDALYGFKGGFDRAGLTLGLKAGGYWPNNLEKRGLINHQSTVFLFDPDTGKVKAMVGGNLLTALRTAAASSVSIKHLARQGAKVIGMIGAGHQATFQLRAALEQRPFEKVIGWNYHPEMLPNIEKVAAEAGVPFEAVDLPGMADADVIISITSAFAPSLMADHVSPGTHIACMGTDTKGKQEVEAELLVKATVFTDEVAQSISIGEAQHAVAQGLIQESDVAQIGAVINGTNPGRTSDDQITLFDGTGVGLQDLAVAASVVEVALEKGIAIEVDF

SEQ ID NO: 75 - protein, 320 aa, Paracoccus sp. J56
MYVVAEKEIAGLMNPEAAFEAIEAVFAAMARRKAYNFPVVREAIGYEDALYGFKGGFDASGLALGLKAGGYWPNNQKHGLINHQSTVFLFDPDTGRVSAAVGGNLLTALRTAAASAVSIKYLAPKGAKVLGMIGAGHQSAFQMRAAANVHGFEKVIGWNPHPEMLSRLADTAAELGLPFEAVDLPQLGEEADVIISITSSFSPLLLNEHVKGPTHIAAMGTDTKGKQELDPALVTRARIFTDEVAQSISIGECQHAIAAGLIKEEQISELGAVVTGDNPGRADAEVTLFDGTGVGLQDLAVAQKVLEIAKEKGIAQQVEI

SEQ ID NO: 76 - protein, 331 aa, Paracoccus aminophilus JCM 7686
MAGFSTRKGLLMYIVAEKEIAGLMTPAAAFEAIEAVFAAMAARKAYNFPVVREAIGYEDALYGFKGGFDGAALTLGLKAGGYWPNNQKHNLINHQSTIFLFDADTGRAKAAIGGNLLTALRTAAASAVSIKYLAPKGAKVLGMIGAGHQSAFQMKAAAAVHSFEKVIGWNPHPEMLTRLAETAAGLGLPFEAVELDRLGAEADVIISITSAFSPLLMDAHVKGETHIAAMGTDTKGKQELDPALVARARIFTDEVAQSISIGETQHAIAAHLIAEEAVHELGAVVTGAIPGRDGAEVTLFDGTGVGLQDLAVAAKVLELAIEKGLAQQAEL

SEQ ID NO: 77 - protein, 321 aa, Rhizobium rhizogenes YR147
MIIVPENEIAGLVTPADCLKAVEGVFASMANKSAYNFPVIREAIGHADALYGFKSGFDRKGLALGLKAGGFWPNNVHKGLTNHQSTVLLFDADTGKCRAVVGGNLLTALRTAAASAISIKYLARKDAKVLGMIGAGHQATFQLRAALAQRPFEKIVGWNLHPDMLCRLEEVAKEEGLPFEAVDLDRLGAEADVIISITSSFAPMLKASQVRAGTHLACMGTDTKGKQEVEAEILAAATVFTDEVAQAITIGESQHAIERGLIREEAIVEIGAVINGTHPGRTSADQITLFDGTGVGLQDLAVASAAVELALAKGVAIEVDF

SEQ ID NO: 78 - protein, 320 aa, Roseinatronobacter thiooxidans DSM 13087
MWIVPESVIADLVDEHSAFDAIEASFAAMARGDAYNFPVVREALGAGRQYGFKSGLDRVGALLGVKAGGYFPGNADRGIPNHQSTVYLFDQDSGKPTAIVGGNLLTALRTAAASAISIAHLARKDAKVLGMVGAGHQSAFQMRAAVRQRQFDRVIGWNLHPDMLSRLAETAAELGLPFEAVDLDQLGAQADVIITITSSFDAILQDAHIRPGTHLACMGTDTKGKQELDPAILTRATVFTDEVAQSISIGEAQHAVGAGILHADAIVEIGAVINGTHHGRRDAQEITVFDGTGVGLQDLAVASRAVALAIERGLAQKIDF

SEQ ID NO: 79 - protein, 321 aa, Citreicella marina DSM 26424
MLIVPEREIADLMTRDAAFAAVEQVFAAMAADKAYNFPVVREAIGHEDALYGFKGGFDRAGLTLGLKAGGYWPNNMDKRGLINHQSTVFLFDPDTGKVRAMVGGNLLTALRTAAASSVSIRHLARKDAKVIGMIGAGHQATFQLRAALEQRGFEKVIGWNYHPEMLPNIEKVATEAGLPFAAVDLPGMAEADVIITITSAFAPSLLAEHVSPGTHIACMGTDTKGKQEVEAALLARATVFADEIAQSVSIGEAQHAIAEGLLQEADIAQLGAVINGTHPGRKDAAEITLFDGTGVGLQDLAVAAAVVDLAVAQGRAIEVDF

SEQ ID NO: 80 - protein, 324 aa, Ruegeria marina CGMCC 1.9108
MSEVLIVGEEICQQIVGRAEAFAAVEAVFAAMDRGEARNFPVVREALGHARALYGFKSGFDQAGHVLGVKSGGYWPGNMDRGLTNHQSTVFLFDPDTGQLSALVGGNYLTAVRTAASSAVSIAHLARRDARVLGMVGAGHQSTFQLRAAAEQRAFEKVVAWNPHPEMLPRLAVVAEELGLEFEAVSPQELGAQADVIISITSAFEPLLMSGWIRPGTHLACMGTDTRGKMEVDSALLARATVFTDEVAQSVSIGEAQHAVSQGLIGAEDITPIGAVINGGHPGRGSEADITLFDGTGVGLQDLAVASVAAKLAVERGLGARASL

SEQ ID NO: 81 - protein, 321 aa, Ruegeria marina CGMCC 1.9108
MLIVPERDIADLMTREAAFDAVEKVFAAMASGDAYNFPVVREAIGHEGALYGFKGGFDRADLTLGLKAGGYWPNNLEKRGLINHQSTVFLFDPDTGKPSAMVGGNLLTALRTAAASSVSIKHLARADAKVIGMIGAGHQATFQLRAALEQRTFEKVIGWNYHPEMLPNIEKVAAEAGLPFEAVDLPGMAGADVIISITSAFAPSLMADHVSPGTHLACMGTDTRGKQEVEAGLLARATVFTDEVAQSISIGEAQHAISDGLIKESDIAQLGAVINGTHPGRTSEDQITLFDGTGVGLQDLAVAAAVVDLAVDRGIAIEVDF

SEQ ID NO: 82 - protein, 326 aa, Thalassobacter sp. 16PALIMAR09
MKSHEIIIVPEAEIAGLMTPEAAFDAVEAIFGAMARKDAYNFPVIREAIGHADALYGFKSGFDRAGGALGLKSGGYWPGNEAKGLTNHQSTVILFDRDTGRPKAMVGGNLLTALRTAAASAVSIKHLARADSKVLGMIGAGHQSAFQMRAALSQRPFEKVIGWNYHPEMLSRLEAVATEAGLPFEAVDLDRLGAEADVIISITSSFDAILQDAQVTAGTHVACMGTDTKGKQEVEAALVARATVFTDEIAQSTTIGEAQHAIASGLITEAAITEIGAVINGTHPGRTSAEEVTLFDGTGVGLQDLAVAEAVVDLALKTGVATRVPF

SEQ ID NO: 83 - protein, 320 aa, Salinihabitans flavidus DSM 27842
MIIVPEREIAGLITPEAAFDAVENVFGAMARGEALNFPVIREAIGHADALYGFKSGFDRAGLVMGLKSGGYWPGNADKGLTNHQSTVILFDPDTGRATALVGGNLLTALRTAAAAAVSIRHLARPDAKVLGMIGAGHQSTFQMRAALAQRRFERVIGWNLHPERLSRLQEVAQEHDLPFEAVDLPQMREADVIITITSSFDPILMSDHVADGTHIASMGTDTKGKQELEPALVARARRFTDEVAQSVSIGECQHAVAAGLIGADDIAEIGAVINGTYPGREGAREVTLFDGTGVGLQDLAVAAAAVRLAGEKGVAIEVDF

SEQ ID NO: 84 - protein, 320 aa, Paracoccus alcaliphilus DSM 8512
MWIVPEGEIAGLMTPEAAFDAVEAVFAAMARGDASNFPVVREAIGHEDALYGFKGGFDGAGMTLGLKAGGYWPNNAKHGIINHQSTVFLFDPDTGRVSAAVGGNLLTALRTAAASAVSSKYLAPKGAKVLGMIGAGHQSAFQMKAAVRFGDFDRVIGWNPHPEMLTRLADTAAELGLPFEAVELDRLGADADVIISITSAFEPLLLDAHVTGPTHIAAMGTDTKGKQELDPVLVARSRLFTDEVAQSVSIGEFQHAAAQKLISEGDVIALGQVINGQHEGRGDAEVTIFDGTGVGLQDLAVAAAVVELAKQQGKAIEVAI

SEQ ID NO: 85 - protein, 327 aa, Paracoccus sp. PAMC 22219
MQTQSPLLIVPEHLIADLISAQDCFAAVEQVFAAMARDTAYNFPVIREAIGHADALYGFKSGFDRESLALGLKSGGFWPRNADKGLTNHQSTIFLFDADTGRCRAVVGGNLLTALRTAAASAVSIRHLARPDARVLGMIGAGHQSTFQLRAALDQRDFDKVVGWNLNPADLDRLAKVAGERGIPFQAVDLDQLGAQADVIITITSSFAPILQAAQVRPGTHLACMGTDTKGKQEVEAALLAKASVFTDEVAQSVTIGEAQHAVAQGLIAEGDITQIGAAINGDRPGRVSDDQITLFDGTGVGLQDLAVASAAVDLAVERGIAIQVQI

SEQ ID NO: 86 - protein, 321 aa, Loktanella sp. 5RATIMAR09
MIIVPEKEIAGLLTRADAFDAVEKVFASMSKGSAYNFPVIREAIGYEDALYGFKGGFDKAGMALGLKAGGYWPNNLEKHGHINHQSTVFLFDPDTGMVKAMVGGNLLTALRTAAASSVSIKHLARKDAKVMGMVGAGHQATFQLRAALEQRNFEKVIGWNYHPEMLPNIEKVANEAGVPFEAVPLEGLAEADVVISITSTFAPTIMADHIAPGTHIACMGTDTKGKQEVEASLLARATVFTDEVAQSISIGEAQHAVASGLIEQSDVHELGAVINGTHPGRTSADEITLFDGTGVGLQDLAVASSIVDLAVEKGIAIIVDF

SEQ ID NO: 87 - protein, 332 aa, Psychrobacter urativorans R310.10B
MIEENNINNEGLLIVSEDACKAVIDRDSAFTAVKNVFASMSRGDAYNFPVIREAIGYADALYGFKSGFDRAGKSLGLKSGGYWPGNAAKGLTNHQSTIFLFNPDNGKLRALVGGNYLTAVRTAAASAVSIAHLARKDSKVLGMVGAGHQSTFQLRAALEQRNFEKVIAWNKDADRLSILQEIAEELGIPFESVEREQLCAEADVIITITSAFEPLLMKEWIKPGTHIACMGTDTVGKQEVDAALIVSATVFTDEIAQSISIGEAQHAIKSGAITADAITTLGDVINGEHPGRSSDDEITLFDGTGVGLQDLAVASAAARLAVEKGQAQHISL

SEQ ID NO: 88 - protein, 321 aa, Octadecabacter temperatus SB1
MYIVPEAAIADILTRDAAFDAVENVFAAMSAGDAYNFPVIREAIGHEDALYGFKGGFDGKGMSLGLKAGGYWPHNLAERGLINHQSTVFLFDPDTGKVAAMVGGNLLTALRTAAASSVSIKHLARKDSKVMGMIGAGHQAKFQLRAALETHQFEKVIGWNRNANALSTLADVAAEFDLPFEAVSLEGMVEADVVISITSVFSPIFGAAHISDGTHVACMGTDTIGKQEADTDLVTKATVFTDEVAQSVTLGEAQHAVGAGLKSREDIHELGAVINGTHKGRTSDTEITLFDGTGVGLQDLAVSASIVEIAKAKGIGLEVDF

SEQ ID NO: 89 - protein, 321 aa, Leisingera sp. ANG-S
MYIVPEKAIADLVTREASFDAVEKVFAAMAAGDAYNFPVVREAIGHEDALYGFKGGFDRAGLTLGLKAGGYWPNNLEKRGLINHQSTVFLFDPDTGKVKAMVGGNLLTALRTAAASSVSIKHLARQDAKVIGMIGAGHQATFQLRAALEQRQFEKVIGWNYHPEMLPNIEKVAAEAGLPFEAVDLPGMAEADVIISITSAFAPSLMADHVSPGTHVACMGTDTKGKQEVEAELLVKASVFTDEVAQSISIGEAQHAVAQGLIQESDVAQIGAVINGTNPGRTSDDQITLFDGTGVGLQDLAVAASVVEVAVEKGIAIEVDF

SEQ ID NO: 90 - protein, 334 aa, Neptunomonas antarctica DSM 22306
MLAPVDPPTNKKGISIVSEDVCQQTVGRPEAFTAVENVFAAMARGDAYNFPVVREAIGHADALYGFKSGFDRAGMSLGVKSGGYWPGNAAKGLTNHQSTIILFDPDTGQIKSIVGGNYLTAVRTAASSAVSIAHLARKDAKVLGMIGAGHQSTFQLRAAVEQRDFEKVLAWNPHPKNLVRLATVCAELGLPFEAVEREQLCAEADVIITITSAFEPLLRHEWIKPGTHIACMGTDTKGKQEVDPALLVAATLFTDEIAQSISIGEAQHAVASGALKAGDITSLGDVINGDHCGRSSAEEITLFDGTGVGLQDLAVASVAVQLADERKLSSKISL

SEQ ID NO: 91 - protein, 321 aa, Sinorhizobium fredii CCBAU 83753
MIIVPENQIAGLMTPADCLVAVEEVFASMAKRSAYNFPVIREAIGYADALYGFKSGFDRSNLALGLKSGGFWPNNVQIGLANHQSSVFLFDADTGKCRAVVGGNLLTALRTAAASAISIKHLARKDAKVLGMIGAGHQSAFQLRAAVEQRSFEKILAWNLHPEMLSRLAEVAMELKLPFKIVDLERLGAESDVIISITSSFAPIFKASQVRPGTHLACMGTDTKGKQEMEAELVAAATVFTDEVAQAVTIGECQHAIEKKLLSRDDITELGAVITGRHPGRSSPDEITLFDGTGVALQDLAVASAAVAHAVSRGTAIEVDF

SEQ ID NO: 92 - protein, 321 aa, Defluviimonas indica DSM 24802
MLIVPEREIADLMTREAAFDAVEKVFAAMASGDAYNFPVIREAIGHEDALYGFKGGFDRAGLTLGLKAGGYWPNNLERHGLINHQSTVFLFDADTGMVKAMVGGNLLTALRTAAASSVSIKHLARRDAKVLGMVGAGHQATFQLRAALEQRAFEKVIGWNYHPEMLPRIEKVAAEAGVPFEAVELDGMREADVIISITSAYAASLMAKHVSPGCHVACMGTDTKGKQEVEAALLARATVFTDEIAQSVTIGEAQHAIAEGLIGESDIAQLGAVINGTLPGRTSQEQITLFDGTGVGLQDLAVAASVVALAVEKGAAIEVDF

SEQ ID NO: 93 - protein, 328 aa, Marinomonas sp. S3726
MSTENKGVSIVSEKTCQAVVGRPEAFTAVENVFAAMAKNSAYNFPVVREAIGHADALYGFKSGFDRDGMVLGVKAGGYWPGNAQQGITNHQSTVILFDPDTGKIKSLVGGNYLTAVRTAASSAVSIAHLARKDSKVLGMVGAGHQSTFQLRAAVEQRDFEKVVAWNFHPDMLPNLEKVCVELGLPFEAVSREELGAQADVIITITSAFESLMQKDWIKPGTHIACMGTDTKGKQEVDADLLAAATVFTDEVAQSISLGEAQHAIESGLIQISDITPIGEVINGTHQGRTSEDEITLFDGTGVGLQDLAVASAAADLAEAQGKANFIDL

SEQ ID NO: 94 - protein, 321 aa, Oceanicola flagellatus CGMCC 1.12644
MLIVPEREIANLMTRSAAFDAVESVFAAMASKNAYNFPVIREAIGHEDALYGFKGGFDKQGMTLGLKAGGYWPNNLEKHGVINHQSTIFLFDPDTGMVKAMVGGNLLTALRTAAASSVSIKHLARKDAKVMGMVGAGHQATFQLRAALEQRPFEKVIGWNYHPEMLPNIEKVANEAGVPFEAVELDGMVEADVVISITSTFEPTVMAKHISPGTHIACMGTDTKGKQEVEAALLGKATVFTDEVAQSITIGEAQHAIYNHMIRPENIVQIGEVINGTHKGRTSDDEITLFDGTGVGLQDLAVAASVVELAVKNGVAIEVDF

SEQ ID NO: 95 - protein, 321 aa, Phaeobacter inhibens S4Sm
MRIVPEAIIKDHISREDSFEAVEQVFASMAARSAYNFPVIREAIGHADALYGFKSGFDRNALNLGLKSGGYWPGNSEKGLTNHQSTVFLFDADTGKCSAIVGGNLLTALRTAAAAAVSVAHLARKDAEVLGIVGAGHQASFQLRAVAEQRDFKKVVAWNRSPEKLATLEQVARELGLPFEAVSVEDLCAQSDVIVTITSSFDAIIHSDQVRPGTHIACMGTDTKGKQEVDAALVARSSVFTDEIAQSTTIGEAQHAVAIGSLSEAAIVELGAVINGAHPGRGSADEVTLFDGTGVGLQDLAVAATVVERASKAGAAIDVDF

SEQ ID NO: 96 - protein, 321 aa, Brevirhabdus pacifica DSM 27767
MYVVPESAIADLISPQDSFEAVESVFAAMARKDAYNFPVIREAIGHADALYGFKSGFDRAGLVLGLKAGGYWPGNADKGLTNHQSSVFLFDPDTGRPTAMVGGNLLTALRTAAASAVSIRYLAPKGAKVLGMIGAGHQSAFQMRAAAKQRDFEKVIGWNFHPEMLSRLEETAAELGLPYESVDLDRMGAEADVIVSITSSFDPILKDAQVKGGTHLACMGTDTKGKQEVEAALLARARVFTDEIAQSITIGEAQHAVADGSLAESDITEIGAVIAGMDPGRRSDDEITLFDGTGVGLQDLAVAAKAVELARERGIGQEIEV

SEQ ID NO: 97 - protein, 321 aa, Methylobacterium radiotolerans SB3
MIIVPEHAIDGLLTEAECFGAVEQVFASMARRRAGNFPVVREAIGHADALYGFKSGFDRDSLALGLKAGGFWPGNAAKGLTNHQSTVFLFDADTGRCRAVVGGNLLTALRTAAACAISIRHLAREGARVLGMIGAGHQSAFQLRAALVQRPFERVLAWNLHPGMFGRMEAVARERGVPFEVVDLDRLGAEADVVVTITSSFAPILKAAQVRPGTHVACMGTDTRGKQEVEAELLAAATVFTDEVAQSVSLGEAQHAVARGLLAADSIVEIGAVINGDHPGRVSDAEITVFDGTGVGLQDLAVAAVAVDRALAKGLATEVGF

SEQ ID NO: 98 - protein, 321 aa, Pelagimonas varians DSM 23678
MLIVPERDIADLMTRDAAFDAVERVFAAMAAGDAYNFPVVREAIGHEEALYGFKGGFDQSGLTLGLKAGGYWPNNLEKRGIINHQSTIFLFDPDTGKVKAMIGGNLLTALRTAAASSVSIKHLARPDAKVIGMIGAGHQATFQLRAALEQRNFEKVIGWNYHPDMLPNIEKIATEAGVPFEAVELEGMRQADVIISITSAFAPSLMADHVAPGTHVACMGTDTKGKQEVEAALLAKAAVFTDEVAQSITIGEAQHAVAQGLIAEADVAQLGAVINGTDAGRTSEDQITLFDGTGVGLQDLAVAAAVVDLAVEQGIAIEVDF

SEQ ID NO: 99 - protein, 321 aa, Thalassobius mediterraneus 5120
MHIVPERDIADLMTRAAAFDAVEKVFAAMAAEDAYNFPVIREALGHEEALYGFKGGFDRAGSTLGLKAGGYWPHNLEKRGLINHQSTVFLFDPDTGKVSAMVGGNLLTALRTAAASSVSIKHLAREDAKVIGMVGAGHQATFQLRAALEQRSFEKVIGWNLHPEMLPNLEKVAAEAGLPFEAVDLPGLKEADVVITITSSFDPIVLSEHISDGTHVACMGTDTIGKQEVAADLLTRATVFTDEVAQSTTLGEAQHAVANGSLTADQITQLGAVINGTHGGRASDREVTLFDGTGVGLQDLAVAARVVELAIEKGTAIEVDF

SEQ ID NO: 100 - protein, 321 aa, Jannaschia sp. CCS1
MYIVPERAIADLMTREAAFDAVEKVFAAMAAGDAYNFPVVREAIGHEDALYGFKGGFDQAGLTLGLKAGGYWPNNLEKRDLINHQSTVFLFDPDTGKAKAMVGGNLLTALRTAAASSVSIKHLARDDAKVIGMIGAGHQATFQLRAALEQRTFEKVIGWNYHPDMLPNIEKVATEAGVPFEAVDLPGMAEADVIISITSAFAPSLMADHVAPGTHIACMGTDTKGKQEVEAALLARATVFTDEVAQSVSIGEAQHAVADGLIAEGDVHQLGAVINGTHAGRASADEITLFDGTGVGLQDLAVAASVVDLAIKKGVAIEVDF

SEQ ID NO: 101 - protein, 321 aa, Mesorhizobium sp. BNC1
MIIVPEREISGLISAADCFTAVEQVFASMARKSATNFPVIREAIGHAGALYGFKSGFDRESLALGLKSGGFWPNNVEKGLTNHQSTIFLFDADTGRCRAVVGGNLLTALRTAAASAVSIKYLARRDAQVIGIVGAGHQSTFQLRAALDQRAFKKVVGWNIDPEMLSRLQVVAAERNIPFESVDLDRLGAEADVIITITSSFASLLKAAQVRPGTHLACMGTDTKGKQEVEAELVAMATVFTDEVAQSISIGEAQHAVEKGLLAAGDIIELGQVINGMHPGRSSDDEITLFDGTGVGLQDLAVASAAVDLAIARGVALEVDF

SEQ ID NO: 102 - protein, 321 aa, Mesorhizobium sp. BNC1
  MISC_FEATURE (1)..(321): plasmid 1
MIIVPERLISDLMSEAAVFEAIESVFAAMARDEARNFPVIREAIGYADALYGFKAGFDSAGLVLGVKAGGYWPGNMAKGLTNHQSTVLLFDPDTGRIKAAVGGNLLTALRTAAASAVSIKHLARPDARVLGMVGAGHQSAFQMRAAVRARKFDKVVGWNLHPEMLSRLADTAVELGLPFEVVDLPQLGAQADVIITITSSFAPILLSGHIRPGTHLACMGTDTKGKQEVEAALFPRARLFADEVEQSVTIGEAQHAVAQGLIATGDITPLGAVIAGLAPGRTSPEEITLFDGTGVGLQDLAVASVAVDIARARGLALEVEL

SEQ ID NO: 103 - protein, 333 aa, Roseovarius sp. TM1035
MNTHKEVAADGFVIVGEEICQKIISRADAFGAVEAVFAAMARGDAYNFPVVREAIGHADALYGFKGGFDRSGLSLGLKAGGYWPGNMDKGLTNHQSTVFLFDPDTGRLSALVGGNYLTAIRTAASSSVSIAHLARKDAKVLGMVGAGHQSAFQLRAAVEQRAFEKVVAWNPHPDMLPRLGAVAKELGLEFEAVTQEELGAQADVIITITSAFEPLMMADWVKPGTHIACMGTDTKGKQEVDPALFTRATVFADEIAQSITIGEAQHAVGKGLIAEGDITPIGAVINGTHGGRSNAEEITLFDGTGVGLQDLAVASVAAKLAREQGLVTPITLG

SEQ ID NO: 104 - protein, 321 aa, Methylobacterium radiotolerans JCM 2831
  MISC_FEATURE (1)..(321): plasmid pMRAD01
MIIVPEHAIDGLLTEAECFGAVEQVFASMARRRAGNFPVVREAIGHADALYGFKSGFDRDSLALGLKAGGFWPGNAAKGLTNHQSTVFLFDADTGRCRAVVGGNLLTALRTAAACAISIRHLAREGARVLGMIGAGHQSAFQLRAALAQRPFERVLAWNLHPGMFGRMEAVARERGVPFEVVDLDRLGAEADVVVTITSSFAPILKAAQVRPGTHVACMGTDTRGKQEVEAELLAAATVFTDEVAQSVSLGEAQHAVARGLLAADSIVEIGAVINGDHPGRVSDAEITVFDGTGVGLQDLAVAAVAVDRAVAKGLATEVDF

SEQ ID NO: 105 - protein, 347 aa, Rhizobium sp. NGR234
  MISC_FEATURE (1)..(347): plasmid pNGR234b
MACLGSGQGVLTKEGHRPSCNQSEGKMIIVPESQIPALVTSADCFVAVEDVFASMSKQSAYNFPVIREAIGHADALYGFKSGFDRESLALGLKSGGFWPNNIHKGLANHQSTVFLFDADTGKCRAIVGGNLLTALRTAAASAVSIKYLARQDAKVLGMIGAGHQSTYQLRAAVEQRPFEKVLAWNFHPEMLSRLEDVAKELELPFETVDLDRLGAEADVIISITSSFAPILKASQVRPGTHLACMGTDTKGKQEMDADLVAGATVFADEVAQAVTIGECQHAFEKGLITRDDIIELGAVITGRHPGRSSPEEITLFDGTGVALQDLAVASAAVELALSRGTAIEVDF

SEQ ID NO: 106 - protein, 321 aa, Citreicella sp. SE45
  MISC_FEATURE (1)..(321): genomic scaffold scf_1113211290443
MLIVPEREIADLMTREAAFSAVEQVFAAMAAGNAYNFPVVREAIGHEDALYGFKGGFDRAGLTLGLKAGGYWPHNLEKRGMINHQSTVFLFDPDTGKAKAMVGGNLLTALRTAAASSVSIRHLAREDAKVIGMVGAGHQATFQLRAALEQRDFDKVIGWNLHPEMLPNLEKVAAEAGLPFEAVELEGMRAADVIISITSSFDAILMEEHVAPGTHIACMGTDTKGKQEVAPALLAKATVFTDEVSQSVSIGEAQHAVAQGLIRETDISQLGAVINGAHPGRRSAEEITLFDGTGVGLQDLAVAAAVVDLAVEKGIAIEVDF

SEQ ID NO: 107 - protein, 321 aa, Citreicella sp. SE45
  MISC_FEATURE (1)..(321): genomic scaffold scf_1113211290440
MLIVPEREIGALMTRASAFEAVEKVFAAMASGEAYNFPVIREAIGHEDALYGFKGGFDRAGLTLGLKAGGYWPNNLEKFKVINHQSTVFLFYPDTGKVAAMVGGNLLTALRTAAASSVSIAHLARRDAKVMGMVGAGHQATFQLRAALEQRPFEKVIGWNLHPEMLPNIETVADEAGLPFEAVPLEGMREADVIVSITSSFAPSLMAAHVSPGTHLACMGTDTRGKQEVEAALLAVATVFTDEVAQSVSIGEAQHAVAEGLISESDVHQIGAVINGSHPGRRSDEEITLFDGTGVGLQDLAVAAAVVDLAVEKGIAIEVDV

SEQ ID NO: 108 - protein, 321 aa, Artificial Sequence
  synthetic sequence
  MISC_FEATURE (1)..(321): pCaer_C109
MYIVPEKAIADLVTREASFDAVEKVFAAMAAGDACNFPVVREAIGHEDALYGFKGGFDRAGLTLGLKAGGYWPNNLEKRGLINHQSTVFLFDPDTGKVKAMVGGNLLTALRTAAASSVSIKHLARQDAKVIGMIGAGHQAKFQLRAALEQREFEKVIGWNLHPEMLPNLQEVADEAGLPFEAVELDGMREADVIISITSSFDAILKADQVSPGTHIACMGTDTKGKQEVDPQLLVKADVFTDEVAQSISIGEAQHAVTQGLIQEADVAQIGAVINGTNPGRTSDDQITLFDGTGVGLQDLAVAASVVDVAVEKGVAIEVDF

SEQ ID NO: 109 - protein, 293 aa, Ensifer fredii USDA257
MAKRSAYNFPVIREAIGHADALYGFKSGFDRDSLALGLKSGGFWPNNVQNGLANHQSTVFLFDADTGRCRAVVGGNLVTALRTAAASAVSIKYLARKNAKVLGMIGAGHQSTYQLRAAVEQRPFEKVLAWNLHPEMLSRLEGVARELELPFETVDLDRLGDEADVIISITSSFAPILKASQVRPGTHLACMGTDTKGKQEMDAELIAAATVFTDEVAQAVTIGECQHAIEKGLISKDDIVEIGAVITGRHKGRSSPEEITMFDGTGVALQDLAVASAAVAHAVSRGTAIEVDF

SEQ ID NO: 110 - protein, 320 aa, Paracoccus pantotrophus J46 ICCP
MLVVAEKEIAGLMTPEAAFEAIEAVFASMARRKAYNFPVVREAIGHEDALYGFKGGFDAAALTLGLKAGGYWPNNQKHGLINHQSTVFLFDPDTGRVSAAVGGNLLTALRTAAASAVSIKHLAPKGAKVLGMIGAGHQSAFQMRAAANVHRFEKVIGWNPHPEMLSRLADTAAELGLPFEAVELDRLGAEADVIISITSSFSPLLLNEHVKGPTHIAAMGTDTKGKQELDPALVARARVFTDEVAQSVSIGECQHAIASGLIREDQIGELGAVVAGDDPGRGDAEVTIFDGTGVGLQDLAVAQKVLEIAKQEGLAQEVEI

SEQ ID NO: 111 - protein, 320 aa, Paracoccus sp. J4
MLVVAEKEIAGLMTPEAAFEAIEAVFASMARRKAYNFPVVREAIGHEDALYGFKGGFDASALTLGLKAGGYWPNNQKHNLINHQSTVFLFDPDTGRVSAAVGGNLLTALRTAAASAVSIKYLAPKGAKVLGMIGAGHQSAFQMRAAANVHRFEKVIGWNPHPEMLSRLADTAAELGLPFEAVELDRLGTEADVIISITSSFSPLLMDQHVKGPTHVAAMGTDTKGKQELDPALVARARVFTDEVAQSVSIGECQHAIASGLIREDQIGEIGAVVAGDNPGRGDAEVTIFDGTGVGLQDLAVAKAVVELAKHKGVAQEVEI

SEQ ID NO: 112 - protein, 327 aa, Solemya velum gill symbiont
  MISC_FEATURE: Draft Solemya velum gill symbiont genome
MEAEKGVVVVSEATCEEVIDRASSFTAVESVFAAMARGDAYNFPVVREAIGHADALYGFKSGFDRAGMSLGVKSGGYWPGNVNLGIPNHQSTVFLFDPDTGRLKAMVGGNYLTAVRTAASSAVSINHLARKDAKVLGMVGAGHQSKFQLRAAADQRDFEKVVAWNPHPEMLPGLKAVADELGLPFESVEREELCAQADVIITITSAFEALLMKEWIKPGTHIACMGTDTKGKQEVDTALVESATLFTDEIVQSITIGENQHAIESGAISESDITPIGDVINGKHPGRSHADEITLFDGAGVGLQDLAVASVAVDLALEKDQAQHVSL

SEQ ID NO: 113 - protein, 320 aa, Paracoccus sp. N5
MFVVAEKEIAGLMTPEAAFEAIEAVFASMARRKAYNFPVVREAIGHEDALYGFKGGFDASALVLGLKAGGYWPNNQKHNLINHQSTVFLFDPDTGRVSAAIGGNLLTALRTAAASAVSIKYLAPKGAKVLGMIGAGHQSAFQMRAAAAVHGFEKVIGWNPHPEMLTRLADTAADLGLPFEAVELDRLGAEADVIISITSSFSPLLMDQHVKGPTHIAAMGTDTKGKQELDPALVARARVFTDEVAQSVTIGECQHAIAAGLIAEEAIGELGAVVSGDDPGRDGAEVTIFDGTGVGLQDLAVAQKVLEIAKEKGLAQEVEI

SEQ ID NO: 114 - protein, 334 aa, Roseovarius mucosus DSM 17069
MMNTQQQVAADGFVIVGEEICQKIISRADAFGAVEAVFAAMASGDAYNFPVVREAIGHADALYGFKGGFDRSGLSLGLKAGGYWPGNMDKGLTNHQSTVFLFDPDTGRLSALVGGNYLTAIRTAASSSVSIAHLARKDSKVLGMVGAGHQSTFQLRAAVEQRAFEKVVAWNPHPDMLPRLGAVAKELGLEFEAVTQEELGAQADVIITITSAFEPLMMADWIKPGTHIACMGTDTKGKQEVDPALFTRATVFADEIAQSITIGEAQHAVAKGLIAEGDITPIGAVINGTHGGRASEAEITLFDGTGVGLQDLAVASVAAKLAREQGLVTPITLG

SEQ ID NO: 115 - protein, 334 aa, Marinobacter sp. BSs20148
MDTSSEALTQPHQILIVSEDACQKVIGRHEAFQAVESVFSSMAKGSAYNFPVVREAIGHANALYGFKSGFDSEGLVLGVKAGGYWPGNVVQGRTNHQSIVALFDPDTGQLKALIGGNYLTAIRTAASSAVSIAHLARKNAKVLGMIGAGFQSTFQLHAALEQRDFEKVVAWNTHPEHLTRLADVCREHGLPFEAVSLQTLGAQSDVIITITSASEPLLQAAWIKPGTHLACMGTDTKGKQEVDQQLLARASVFTDEIAQSISIGEAQHAVAAKILFAEQITPIGEVINGSHQGRQSEQEITLFDGTGVGLQDLAVASAAASLAEVRGLAQRVTL

SEQ ID NO: 116 - protein, 321 aa, Ensifer sp. USDA 6670, CC2017
MIIVPENQIAELITPADCLVAVEGVFASMAKRSAYNFPVIREAIGHADALYGFKSGFDRESLALGLKSGGFWPNNVREGLANHQSTVFLFDADTGRCRAIVGGNLLTALRTAAASAVSIKYLARKDAKVLGMIGAGHQSTYQLRAAVEQRPFEKVLAWNLHPEMLSRLEGVARELELPFETVDLDRLGAEADVIISITSSFAPILEASQVRPGTHLACMGTDTKGKQEMDAELLAAATVFTDEVAQAVTIGECQHAIEKGLISRDNIVEIGAVITGCHTGRSSPEEITLFDGTGVGLQDLAVASAAVELALSKGTAIEVDF

SEQ ID NO: 117 - protein, 321 aa, Rhizobium etli CNPAF512
MIIVPESAIGELISLEDCVDAVEKVFVSMAERSAHNFPVVREAIGYADALFGFKSGFDREGLALGLKAGGFWPNNADKGLTNHQSTVFLFDPETGRCRAVVGGNLLTALRTAAASAVSIKHLARRDAKVLGMVGAGHQASFQLRAAVQQRQFEKVVAWNYHPEMLPKLAAVAEELAVPFEAVDLDRLGDEADVIITITSSFQPILKASQIRPGTHLACMGTDTKGKQEVDPALVAAATLFTDEIAQAISIGECQHAVAQGMIAPIDIAEIGAVINGQKSGRTSLEEVTLFDGTGVGLQDLAVAQAAVELALARGIAVEVDF

SEQ ID NO: 118 - protein, 321 aa, Sulfitobacter sp. 20_GPM-1509m
MLIVPEREIANLMTRAAAFDAVEQVFAAMAAGDAYNFPVVREAIGHEDALYGFKGGFDRAGLTLGLKAGGYWPNNLEKRDLINHQSTVFLFDPDTGKARAMVGGNLLTALRTAAASSVSIKHLARKDARVIGMVGAGHQATFQLRAALEQRDFDKVIGWNYHPEMLPNIEKIAREAGVPFQAVDLPGMVEADVIISITSAFSPSLMADHVAPGCHLACMGTDTKGKQEVEAALLARATVFTDEVAQSVSIGEAQHAVAEGLIAESDVHQLGAVINGTHAGRVSDDQITLFDGTGVGLQDLAVAAAVVDLAVAQGIAIEVDF

SEQ ID NO: 119 - protein, 321 aa, Maribius sp. MOLA 401
MLIVPEREIPDLLTRGASFDAVEKVFAAMAAGDAYNFPVVREAIDHEDALYGFKGGFDAKGQVLGLKAGGFWPNNMERRQIINHQSTVFLFDPDTGRVAAMVGGNYLTALRTAAASSVSIRHLARGDAKVLGMIGAGHQASFQLRAALEQREFERVIAWNYHPEMLPNLAKICDEVGVPFQAVELDGMREADVIVSITSAFAPSLMADHVAPGTHVACMGTDTKGKQEVEAQLLARATVFADEVAQSVSIGEAQHAIAEGLIDKAGIHQIGAVINGTHPGRRSDGEITLFDGTGVGLQDLAVAAAIVDLAKAKGVAIEVEF

SEQ ID NO: 120 - protein, 342 aa, Amphritea atlantica DSM 18887
MGGSIEERSFEELSPVDAGAGISLVSEAVCEQVVGRPEAFTAVESVFAAMASGAAYNFPVVREAIGHADALYGFKSGFDRAGMVLGVKSGGYWPGNVDKNLTNHQSTVILFDPDTGQLRSLVGGNYLTAVRTAAASAVSIAHLARKDARVLGMVGAGHQSTFQLRAALEQRNFEKVVAWNPHPEYLSRLAAVCEELGMPFAAVEREQLGAEADVIITITSAFEPLLMKQWIKPGTHIACMGTDTKGKQEVDPELLASASVFTDEVAQSISIGEAQHAVASGLLNEADITPIGEVINGTHPGRRDDLEITLFDGTGVGLQDLAVASAAVELAQAKGLAGQVSL

SEQ ID NO: 121 - protein, 320 aa, Rhodobacteraceae sp. HL-91
MWIVPESAIGGLVDDQSAFDAVEATFAAMARDDAYNFPVVREALGEGRQYGFKSGLDRAGAQLGVKAGGYFPGNAAKGIINHQSTVFLFDPDTGILQAAVGGNLLTALRTAAASAISIAHLSRADSTVLGMVGAGHQSVFQMRAALRQRKFERVVAWNYHPDMMDRLASAVAEEGLPFEEVSLEELGAQADVIITITSSPAASLMDAHVRPGTHIACMGTDTIGKQEVDPALLARAAVFTDEVAQSVTIGEAQHAIAQGLIKPEDITPIGAVINGAHKGRTSAEEITLFDGTGVGLQDIAVASKAVDLARANGSAIEVAL

SEQ ID NO: 122 - protein, 321 aa, Methylobacterium sp. UNCCL143
MIIVPEHAIDGLLTEAECFTAVEQVFASMARRRAGNFPVVREAIGHADALYGFKSGFDRDSLALGLKAGGFWPGNAAKGLTNHQSTVFLFDADTGRCRAVVGGNLLTALRTAAACAISVRHLARKDARVLGMIGAGHQSAFQLRAALAQRPFERVLAWNLHPGMFGRMEAVAREHGVPFEAVDLDRLGSEADVVVTITSSFAPILKAVQVRPGTHLACMGTDTRGKQEVEAELLAAATVFTDEVAQSVSIGEAQHAVARGLLAADSIVEIGAVINGDHPGRVSESEITLFDGTGVGLQDLAVAAVAVDRAVAKGLATEVEV

SEQ ID NO: 123 - protein, 321 aa, Aquisalimonas asiatica CGMCC 1.6291
MQIVSEKAVKAAVSRADAFTAVESVFAAMATGQAWNFPVVREAIGHADALYGFKSGFDRDHMALGVKSGGYWPGNAARGLTNHQSTVLLFDPDTGQPRALVGGNYLTAVRTAAASAVSIQHLARPDAKTLGIVGAGHQAPFQLRAAVEQRPIERVVAWNRSPERLESLREAAQAMGLPFEAVDRDTLCEQADVIITITSCFEPLLTREQIRPGTHIACMGTDTAGKQEIDPAILASAEVFTDDPTQAATIGECQHAVAQGHIHRDAIRPVGGVIGEPGSFRRSAEAITVFDGTGVGLQDLAVARVALERAVEAGTAVRIDL

SEQ ID NO: 124 - protein, 330 aa, Thalassotalea sp. ND16A
MSDQHNNQGVVVVTEEVCQAIMGRSDAFTAVENVFAAMSKNTAYNFPVIREAIGHADALYGFKSGFDRDSMVLGLKSGGYWPGNVEKGLTNHQSTVILFDPDTGKLKSLVGGNYLTAVRTAASSAVSIAHLARQDSKVLGMIGAGHQSTFQLRAAVEQRNFEKVVGWNIDPERLSILAEVCAELSLPFESVSREELCALSDVIITITSAFEALLDNAWIKPGTHIACMGTDTKGKQEVDAKLFRTATVFTDELAQSITIGEAQHAIQSGLIVESDIVPIGEVINGTNSGRTSEDEITLFDGTGVGLQDLAVASVAAELAQAKGQAFYINL

SEQ ID NO: 125 - protein, 329 aa, Roseovarius lutimaris DSM 28463
MSANTDDGLLIVSEEICEQVIRRPDAFSAVEAVFGAMARGDAYNFPVVREAIGHADALYGFKSGFDRAGMVLGVKAGGYWPGNMAKGLTNHQSTVCLFDPDTGRLVALVGGNYLTALRTAASSAVSIAHLARKDAKVLGMVGAGHQSTFQLRAAVEQRDFERVVAWNPHPDMLPRLAAVAEELGLAFEAVTPEGLGAQADVIITITSAFEPLIMADWIKPGTHIACMGTDTKGKQEVDPALFKSATVFADEIAQSITIGEAQHAVASGLIGEGDLTAIGEVINATHPGRSSDDEITLFDGTGVGLQDLAVASVAARLAREQGLVTPVAL

SEQ ID NO: 126 - protein, 322 aa, Halocynthiibacter sp. PAMC 20958
MIIVPEREIADLMTREVAFNAVEGVFAAMAAQDAYNFPVVREAIGYEDALYGFKGGFDKAGMTLGLKAGGYWPHNLDKHQLINHQSTIFLFDPDTGRVTAMVGGNLLTALRTAAASSVSIKHLARKDSKVIGMIGAGHQATFQLRAALEQREFEKVIGWNYHPEMLPNLEKVANEAGLPFEAVELDQLGHDADVIISITSAFAPSLLAKHVSAGTHIACMGTDTKGKQEVESALLARATVFTDEVAQSISIGEAQHAVAEGLIKESDVNQIGAVINGTHPGRVAADEITLFDGTGVGLQDLAVAASVVALAVKKGVAIDVDF

SEQ ID NO: 127 - protein, 321 aa, Leisingera sp. ANG-S3; identical to SEQ ID NO: 89

SEQ ID NO: 128 - protein, 320 aa, Paracoccus saliphilus DSM 18447
MWVVPEKEIAGLMTPEAAFDAVEAVFAAMASGEANNFPVVREAIGHEDALYGFKGGFDKSALNLGLKAGGYWPNNQKRDLINHQSTVFLFDPDTGRVSAAVGGNLLTALRTAAASAVSIKHLAPEGAKVLGMIGAGHQSAFQMKAAARVGNFERVIGWNPHPEMLTRLADTAAELGLPFEAVELPRLGAEADVIISITSAFEPLLMDAHVKGRTHIAAMGTDTKGKQELDPALVARARLFTDEIAQSLSIGEFQHASAAGSISDGDVTAIGQVITGNHEGRGDAEITIFDGTGVGLQDLAVAGAVVDLARQQGKAVEVEI

SEQ ID NO: 129 - protein, 321 aa, Rhodovulum sulfidophilum DSM 1374
MFIVPEKEIAGLVSADQCFEAVEAVFAAMARGDAYNFPVIREAIGHAEALYGFKSGFDRAGAVLGLKSGGYWPGNAAKGLTNHQSTVVLFDPDSGRPAALVGGNLLTALRTAAASAVSIRYLARSDARVLGVLGAGHQSAFQLRAAVAQRRFEKIVGWNYHPEMLPRLAETAAELGLPFEAVSLEDFGAQADVIVTISSSFSAQLMDAHVRPGTHLACMGTDTTGKQEIDPAIFVRARVFADEIAQSVEIGEAQHAVAAGLIAAEDIVEIGAVINGTAPGRQSDDEITVFDGTGVGLQDLAVAARAVAAARARGVAVEVDL

SEQ ID NO: 130 - protein, 321 aa, Litoreibacter ascidiaceicola DSM 100566
MFIVPEREIADLMTRDAAFDAVESVFAAMASKDAYNFPVIREAIGHEDALYGFKGGFDKAGMTLGLKAGGYWPNNLEKHGHINHQSTIFLFNPDTGMVSAMVGGNLLTALRTAAASSVSIKHLARKDAKVMGMVGAGHQATFQLRAALEQRQFEKVIGWNYHPEMLPNIEKIAIEAGLPFEAVELDGMREADVVISITSTFAPTIMADHIAPGTHIACMGTDTKGKQEVEAALLARATVFTDEVAQSVSIGEAQHAVAQGLIKESDVHQLGAVINGTHKGRTSDDEITLFDGTGVGLQDLAVAASVVELAVAKGVAIEVDF

SEQ ID NO: 131 - protein, 329 aa, Roseovarius marisflavi DSM 29327
MSANTDDGLLIVSEEICEKVIRRPDAFSAVEAVFGAMARGDAYNFPVVREAIGHADALYGFKSGFDRAGMVLGVKAGGYWPGNMAKGLTNHQSTVCLFDPDTGRLTALVGGNYLTALRTAASSAVSIAHLARKDAKVLGMVGAGHQSTFQLRAAVEQRDFERVVAWNPHPDMLPRLAAVAEELGLAFEAVTPEELGAQADVIITITSAFEPLIMADWIKPGTHIACMGTDTKGKQEVDPALFKSATVFADEIAQSITIGEAQHAVASGLIGEGNLTAIGEVINGTHPGRSSAEEITLFDGTGVGLQDLAVASVAARLAREQGLVTPVAL

SEQ ID NO: 132 - protein, 321 aa, Rhodovulum sp. ES.010
MIIVPEKEIAGLVSAEDSFSAVEAVFAAMARGDAYNFPVIREAIGHADALYGFKSGFDRAGLVLGLKSGGYWPGNAEKGLTNHQSTVVLFDADTGQAHALVGGNLLTALRTAAASAVSIKHLARDDAKVLGMVGAGHQSAFQMRAAAAQRDFERVVGWNYHPEMLPRLAETAEELGLPFEAVSLEELGAQADVIVTITSSFEAQLKDTHVRPGTHLACMGTDTKGKQEVDPAILARARVFTDEVAQSITLGEAQHAVAAGLIGEGDITQIGAVIEGTAAGRQSAEEITLFDGTGVGLQDLAVAAKAVDLAQEKGAAIDVAF

SEQ ID NO: 133 - protein, 321 aa, Ruegeria sp. P4
MYIVPERAIADLMTRDAAFDAVEKVFAAMAAGDAYNFPVVREAIGHEDALYGFKGGFDRAGLSLGLKAGGYWPNNLEKRGLINHQSTVFLFDPDTGKVRAMVGGNLLTALRTAAASSVSIKHLAREDAKVIGMIGAGHQAKFQLRAALEQRDFDKVIGWNLHPEMLPNLEEVATEAGLPFEAVELDGLKEADVIISITSSFDAILQADQVSPGTHIACMGTDTKGKQEVDPQLLVRATVFTDEVAQSTSIGEAQHAVAQGLIAEADVAQLGAVINGAHPGRSSAEQITLFDGTGVGLQDLAVAASVVELAVKKGIAIEVDF

SEQ ID NO: 134 - protein, 321 aa, Jannaschia rubra CECT 5088
MIIVPEAVIADLITPEASFTAVERVFASMAARSAYNFPVIREAIGHADALYGFKSGFDRAALNLGLKSGGYWPGNAAKGLTNHQSTVFLFDADTGKCRAVVGGNLLTALRTAAAAAVSVAHLARPDAKVLGIVGAGHQAAFQLRAVAAQRPFEKIVAWNRSPEKLETLRGVADELGLGFESVSIEDLGGQADVIVTITSSHDAILHGAQVKPGTHVACMGTDTKGKREVDNDLIAAATLFTDEVAQSTTIGECQHAIVDLTIRPEDITELGAVINGDHKGRTSAEEITLFDGTGVGLQDLAVASAVVELAMSRGVATEVDF

SEQ ID NO: 135 - protein, 327 aa, Ruegeria atlantica CECT 4292
MTTQEGLLIVGEDLCEQLVGRQQAFDAVQSVFGAMANGGARNFPVVREALGYADALYGFKSGFDRDGQVLGVKSGGYWPGNAEQGLTNHQSTVFLFDPDTGRLSALVGGNYLTAVRTAASSAVSIAHLSRKDAKVLGMVGAGHQSAFQLRAAAEQRGFEKVVAWNPHPDMLPRLAAVAEEIGLEFEAVSQQELGAQSDVIITITSAFEPLLMKDWIKPGTHLACMGTDTKGKMEVDPALVASATVFTDEVAQSATIGEAQHAMGSGTLTETQITPIGAVINGDHPGRSSVDEITLFDGTGVGLQDLAVASVAARLADEAGLAQRATL

SEQ ID NO: 136 - protein, 321 aa, Rhizobium sp. N324
MIIVPERAIADLIGSAECFTAVEQVFAAMARKSAYNFPVVRESIGYADALYGFKSGFDRESLSLGLKSGGFWPKNAEKGLTNHQSTVFLFDADTGRCRAVVGGNLLTALRTAAASAISIKYLAREDAKILGIIGAGHQSTFQLRAAVQQRNFEKVVAWNYHPEMLTRLEDVAKEVGLPFEAVDLHRLGAEADVIISITSSFRPSLMASQVRPGTHLACMGTDTKGKQEVDAKLVAASSLFTDEVAQAITIGECQHAIAAGLIAAEDILEIGAVITGEEKGRRSADDITLFDGTGVGLQDLAVASAVVDLAVSKGVAIEVDF

SEQ ID NO: 137 - protein, 321 aa, Rhizobium sp. N941; identical to SEQ ID NO: 136

SEQ ID NO: 138 - protein, 321 aa, Sinorhizobium americanum CFNEI 73
MIIVPENQIAGLITPADCLVAVEGVFASMAKKSAYNFPVIREAIGHADALYGFKSGFDRDSLALGLKSGGFWPNNVEKGLANHQSTVFLFDADNGRCRAVVGGNLLTALRTAAASAVSIKYLARKDAKVLGMIGAGHQSTYQLRAAVEQRPFEKVLAWNLHPEMLSRLEEVARELELPFETVDLDRLGAEADVIISITSSFAPILKASQVRPGTHLACMGTDTKGKQEMDPELIAAATVFTDEVAQAVTIGECQHAIDKGLISKGDIVEIGAVITGRHKGRSSPEEITLFDGTGVGLQDLAVASAAVELALSKGTAIEVDF

SEQ ID NO: 139 - protein, 321 aa, Puniceibacterium sediminis DSM 29052
MLIVPESKIADLMTPEAAFDAVEATFAAMARKSAYNFPVIREAIGHADALYGFKSGFDRESLVLGLKSGGYWPGNAEKGLTNHQSTIFLFDADTGKCSAIVGGNLLTALRTAAASAVSIKHLARQDSEVLGMIGAGHQSVFQMQAAVKQRNFKKVIGWNYHPEMLSRLADCAAELGLPFEEVSLETLGRDADVIISITSSFAPTLLDAHVTPGTHIACMGTDTKGKQEVEATLLKRATVFTDEIAQSISIGEAQHAVAAGLIAQSDITEIGAVINGTHPGRSSADEITLFDGTGVGLQDLAVAAKVVELAQQKGVALDVDF

SEQ ID NO: 140 - protein, 321 aa, Hyphomicrobium sulfonivorans WDL6
MIIIPEREIAGLISAADCFVAVERVFASMARRSAYNFPVVRESIGHASALYGFKSGFDRENLSLGLKAGGFWPDNAEKGLTNHQSTVFLFDADTGRCRAIVGGNMLTALRTAAASAVSIKYLARADAKVLGMIGAGHQSTFQLEAALDQKLFEKVLGWNIEPNALSRLEAVALKRNIPFERVSLDRLGAEADVIITITSSFAPILKTVQVRPGTHLACMGTDTKGKQEVEASLVAAATVFTDEIGQSIAIGEAQHAINEGLMEADEIVEFGNVVCGNHRGRTSADEITLYDGTGVGLQDLAVASAVVELAITRGVATEMDL

SEQ ID NO: 141 - protein, 321 aa, Marivita geojedonensis DSM 29432
MYIVPEAMIADLVSREASFEAVEQVFAAMAAKDAYNFPVVREAIGHEDALYGFKGGFDRVGGALGLKAGGYWPHNLEKRGLINHQSTVFLFDPDTGKVRAMVGGNLLTALRTAAASSVSIKHLARADARVMGMVGAGHQATFQLRAALEQRPFEKVIGWNYHPEMLPNIEKVANEAGVPFEAVDLPGMAEADVIISITSAFAPSLMADHVSPGTHLACMGTDTKGKQEVESALLARAKVFTDEVAQSVSIGEAQHAVAAGLIAESDVTEIGAVINGTHPGRTSGDDITLFDGTGVGLQDLAVASKVVDLAIERGVAIEVDF

SEQ ID NO: 142 - protein, 332 aa, Marinobacterium mangrovicola DSM 27697
MTTPASGAGNPVSIVSEAVCQQIVGRPEAFKAVENVFAAMARGDAYNFPVVREAIGHADALYGFKSGFDRAGMALGVKSGGYWPGNVQKDLTNHQSTVILFDPDTGQLKSLVGGNYLTAVRTAAASAVSIAHLARRDAKVLGMVGAGHQSTFQLRAALEQRDFEKVVAWNPHPEHLPRLAAVCEELRVPFEAVTQQELGAQADVIITITSAFEPLLLKEWIKPGTHIACMGTDTKGKQEVDPALLAAASVFTDEVAQSISIGEAQHAVASGLIAEADITPIGKVINGTHVGRRDDQEITLFDGTGVGLQDLAVASAAAELAEQQGLSQKIIL

SEQ ID NO: 143 - protein, 321 aa, Stappia aggregata IAM 12614
MIIVPEKEIAGLIGRQESFDAVESVFAAMASGAACNFPVIREAIGHADALYGFKSGFDRSSLALGLKSGGYWPGNMAKGLTNHQSTVFLFDADTGKAKAVVGGNLLTALRTAAASAVSIKHLARKDAKVLGMIGAGHQSAFQMRAAAEQRSFEKVLGWNLHPEMLVRLEATANELGLPYESVDLARLGAEADVIISITSSFDPILMEEHVTPGTHIACMGTDTKGKQEVDTALVAKAKLFTDEVAQSATIGECQHAVASGIVSEDNIIEIGAVINGNHPGRISQSDITLFDGTGVGLQDLAVASAAVDLAIQKGVAIEVDF

SEQ ID NO: 144 - protein, 331 aa, Sagittula stellata E-37
MKDTPQQGDGVLIVGEEACRALVGRAEAFAAVEAVFAAMASGEARNFPVVREAIGHADALYGFKSGFDRAGMALGVKAGGYWPGNAGRGLTNHQSTVCLFDPDTGRLSALVGGNYLTAVRTAASSAVSIAHLARRDAKVLGMVGAGHQSAFQLRAAAEQRAFEKVVAWNPHPEMLPQLAEVAASLGLPFEAVTPEELGAQADVVITITSAFEPLLMRDWIRPGTHVACMGTDTKGKMEVDAALLAAATVFTDEVAQSVSLGEAQHAVAGGLLSEGDITPIGAVINGTHPGRTSDDEITLFDGTGVGLQDLAVASVAARLAEAQGVAARVVL

SEQ ID NO: 145 - protein, 321 aa, Roseobacter sp. CCS2
MIIVPEKEMAGLLNRADAFTAVENVFASMSKGDAYNFPVIREAISHEDALYGFKGGFDKAGMALGLKAGGYWPNNLEKHGHINHQSTVFLFDPDTGMVKAMVGGNLLTALRTAAASSVSIKHLARKDARVMGMVGAGHQATFQLRAALEQREFEKVIGWNYHPEMLPNIEKVADEAGVPFEAVPLEGMVEADVVISITSTFAPTIMADHISPGTHIACMGTDTKGKQEIEAALLAQTTVFTDEVAQSISIGEAQHAIAEGMIQQSDVNELGAVINGTHPGRTSDDEITLFDGTGVGLQDLAVAASIVDVAVEKGIATIVEF

SEQ ID NO: 146 - protein, 338 aa, Roseobacter sp. AzwK-3b
MNDLSAQAPKAAQAGNTVTIVPEAEIAGLMTPEAAFDAVEATFAAMARGDAYNFPVIREAIGHADALYGFKSGFDRESLALGLKSGGYWPGNEARGLTNHQSTVILFDADTGRPSALVGGNLLTALRTAAASAVSIRYLARQDAKVLGMIGAGHQSAFQMRAAVQQRSFEKVVGWNYHPEMLSRLADTAAELGLSFEAVSLEELGAQADVIVTITSSFAPSLLDAHVRPGTHLACMGTDTNGKQEVEAGLLARARVFTDEVAQSVTLGEAQHAVAEGLISADDITQLGAVINGIHPGRSSDQEITLFDGTGVGLQDLAVAAAVVRLAREQGVASEVVL

SEQ ID NO: 147 - protein, 321 aa, Rhodobacteraceae bacterium KLH11
  MISC_FEATURE (1)..(321): scf_1108856220443 genomic scaffold
MIIVPEKEIGALLGRKESYEAVEQVFAAMASGDAYNFPVVREAIGHEDALYGFKGGFDKAGQVLGLKAGGYWPHNLEKRGLINHQSTVFLFDPDTGMPTAMVGGNLLTALRTAAASSVSINHLARKDARVIGMVGAGHQATFQLRAALEQREFEKVIGWNLHPEMLPNIEKVAAEAGLPFEAVELPGMTQADVIVTITSSFAPTLLSDHVADGTHVACMGTDTIGKQEVGTDLITRASVFTDEVAQAITLGESQHAVKAGTKAEADIHQIGAVINGTHTGRSSDDEVTLFDGTGVGLQDLAVASAVVDLAIKQGIAIKVDI

SEQ ID NO: 148 - protein, 321 aa, Rhodobacteraceae bacterium KLH11; identical to SEQ ID NO: 147
  MISC_FEATURE (1)..(321): scf_1108856220445 genomic scaffold

SEQ ID NO: 149 - protein, 321 aa, Silicibacter sp. TrichCH4B
  MISC_FEATURE (1)..(321): genomic scaffold scf_1113354613205
MYIVPERAIADLMTRDAAFDAVEKVFAAMAAGDAYNFPVVREAIGHEDALYGFKGGFDRAGLSLGLKAGGYWPNNLEKRGLINHQSTVFLFDPDTGKVRAMVGGNLLTALRTAAASSVSIKHLAREDAKVIGMIGAGHQAKFQLRAALEQRDFDKVIGWNLHPEMLSNLEEVATEAGLPFEAVELDGLKEADVIISITSSFDAILKADQVSPGTHIACMGTDTKGKQEVDPQLLVRATVFTDEVAQSISIGEAQHAVAQGLIAEADVAQLGAVINGAHPGRSSAEQITLFDGTGVGLQDLAVAASVVELAVKKGIAIEVDF

SEQ ID NO: 150 - protein, 321 aa, Pelagibaca bermudensis HTCC2601
  MISC_FEATURE (1)..(321): 1100011001308
MLIVHEREIAALMTRDAAFSAVEKVFAAMADAKAYNFPVVREAIGHEDALYGFKGGFDRAGLTLGLKAGGYWPHNLEKRGEINHQSTVFLFDPDTGKAKAMVGGNLLTALRTAAASSVSIRHLARDDAKVLGMIGAGHQATFQLRAALEQRAFEKVIGWNLHPEMLPNLEKVAQEAGVPFEAVELPGMTEADVIITITSAFSPSLMAEHVSPGTHIACMGTDTKGKQEVEAALLSRATVFTDEVAQSVSIGEAQHAVAEGALKAEDIAQLGAVINGSHPGRQSAEEITLFDGTGVGLQDLAVAAAVVDLAVEKGVATEVDF

SEQ ID NO: 151 - protein, 320 aa, Paracoccus sp. J39 ICCT; identical to SEQ ID NO: 111

SEQ ID NO: 152 - protein, 320 aa, Paracoccus sp. J55; identical to SEQ ID NO: 111

SEQ ID NO: 153 - protein, 327 aa, Rhodovibrio salinarum DSM 9154
MTDNHQVVVVPEDLCEALVSRADAFQAVEQVFAAMASGDARNFPVVREATGHAEALFGFKSGFDKAGMALGLKAGGFWPGNADKGLTNHQSTVFLFDPDTGRLQALVAGNYLTAVRTAASSSVSIRHLARPDAKVLGMVGAGHQAQFQLRAAAEQRAFEKVVAWNPHPDMLSKLEAVAREIGLPFEAVSQHELGAQAHVIITITSAFEPLLMRDWIKPGTHIACMGTDTKGKQEVDPELVAGARVFTDEVAQSVQLGETQHAVAQGLLAESDITPIGEVINKTHPGRQSDDEITLFDGTGVGLQDLAVAATAAKLAQQQGKAETVRL

SEQ ID NO: 154 - protein, 335 aa, Colwellia piezophila
  MISC_FEATURE (1)..(335): ATCC BAA-637
MSNSQQNNLPKNKGVSVVSEEVCQQVMGRENAFSAVENVFSAMAKNTAYNFPVIREAIGHEDALYGFKSGFDRDGMVLGLKSGGYWPGNMAKGLTNHQSTVILFDPDTGKLKSLVGGNYLTAVRTAASSAVSIAYLARKDSKVLGMIGAGHQSSFQLRAAVEQRDFEKVVCWNFHPEQIPNLAAVAEELGLPFESVTREELCAQADVIITITSAFEALIDKNWIKPGTHIACMGTDTKGKQEVDAKLLAVASVFTDELAQSITIGEAQHAIAQKLIQQSDIVPIGEVINGTKPGRTSDEQITLFDGTGVGLQDLAVASVAAELAEEKGLATYFQL

SEQ ID NO: 155 - protein, 321 aa, Rubellimicrobium mesophilum DSM 19309
  MISC_FEATURE (1)..(321): scaffold version
MIVVPERIIAGLMTRADAFAAIEAVFAAMARGEARNFPVVREAIGHADALYGFKSGFDRAHLDLGLKSGGYWPGNAAKGLTNHQSTVVLFDADTGRCRALVGGNLLTALRTAAAAAVSVAHLARKDSRVLGIVGAGHQAAFQLRAVAEQRPFERVVAWNRSPEKLKGLACAAEEMGLPFESVSLDRLGAEADVIVTITSSFDAILGDAQVRPGTHLACMGTDTRDKKEVDPTLVARASVFTDEVAQAVTIGECQHAVALGLKGEADIVPLGAVINGDHPGRASEEEVTLFDGTGVGLQDLAVASRVVDLAVQKGLATQVEF

SEQ ID NO: 156 - protein, 321 aa, Maritimibacter sp. HL-12
MLIVPERDIAKLLTRKAAFEAVEKVFASMAKGAARNFPVVREAIGHEDALFGFKGGFDRAGMTLGLKAGGYWPHNMAAHGVINHQSTVVLFDPDTGRLRAMVGGNLLTALRTAAASAVSIKHLARPDAAVLGMIGAGHQAAFQLRAALEQRDLVKVIGWNRNPEKLAGLEAVAAEAGVAFETVDLDGMGEADVIITITSSFAPILEHGHVSPGTHVACMGTDTRGKQEVDPGLLARASVFTDQVAQSVSIGEAQHAVGQGLISEAEIGELGAVINKTLPGRTTDDQITLFDGTGVGLQDLAVAASVVEMAVDQGLAIEVAL

SEQ ID NO: 157 - protein, 321 aa, Methylobacterium sp. L2-4; identical to SEQ ID NO: 104

SEQ ID NO: 158 - protein, 321 aa, Ensifer fredii GR64
MIIVPENQIAGLMTPADCLVAVEEVFASMAKRSAYNFPVIREAIGYADALYGFKSGFDRANLALGLKSGGFWPNNVQKGLANHQSSVFLFDADTGKCRAVVGGNLLTALRTAAASAISIKHLARKDAKVLGMIGAGHQSTFQLRAAVEQCSFEKILAWNFHPEMLSRLEEVARELELPFEAVELDRLGAESDVIISITSSFAPILKASQVRPGTHLACMGTDTKGKQEMEAGLVAAATVFTDEIAQAVTIGECQHAIERKLLSRADITELGAVITGRHPGRSSPDEITLFDGTGVGLQDLAVASAAVAHAVSRGTAIEVDF

SEQ ID NO: 159 - protein, 321 aa, Ponticoccus litoralis DSM 18986
MLIVPEREIADLMTREAAFAAVESVFAAMASGDAYNFPVVREAIGHEDALYGFKGGFDRAGLTLGLKAGGYWPHNLEKRKEINHQSTVFLFDPDTGKARAMVGGNLLTALRTAAASSVSIRHLAREEAKVLGMIGAGHQATFQLRAALEQRPFEKVVAWNLHPEMLPNLEKVAQEADVPFEAVELPGMAQADVIITITSAFAPSLLAEHVSPGTHIACMGTDTKGKQEVEAALLTHATVFTDEVAQSVSIGEAQHAVADGTLKPGDIAQLGAVINGTHPGRQSAEEITLFDGTGVGLQDLAVAASVVDLAVEKGVAIEVDF

SEQ ID NO: 160 - protein, 321 aa, Rhizobium sp. OK494
MIIVPETEIAGLVTPADCFRAVEGVFASMADKSAHNFPVVREAIGHADALYGFKSGFDRKGLALGLKAGGFWPNNVHKGLTNHQSTVFLFDPDTGKCRAVVGGNLLTALRTAAASAISIKYLARKDAKVLGMIGAGHQATFQLRAALAQRPFERIVGWNLHPDMLSRLEEVAKEEGLPFEAVDLDRLGAEADVIISITSSFAPMLKASQVRAGTHLACMGTDTKGKQEVEAEILAAAAVFTDEVAQAVTIGESQHAIERGLIREEAIVEIGAVINGTHPGRTSADQITLFDGTGVGLQDLAVASAAVELALAKGVAIEVDF

SEQ ID NO: 161 - protein, 321 aa, Planktotalea frisia DSM 23709
MWIVPEREIADLLTRDASFDAVEKVFAAMAAGDAYNFPVIREAIGHEDALYGFKGGFDGVGGTLGLKAGGYWPHNLEKRNLINHQSTVFLFDPDTGKVAAMVGGNYLTALRTAAASSVSIKHLARTDAKVMGMVGAGHQATFQLRAALEQREFEKVIGWNYHPEMLPNIEKVANEAGVPFEAVELEGLGEADVVISITSTFAPTIMADHISAGTHIACMGTDTKGKQEVEAALLARATVFTDEVAQSISIGEAQHAIEAGLIQEADVHQIGAVINATHKGRTSDDEITLFDGTGVGLQDLAVSAAIVRMAIEQGVAIEVDF

SEQ ID NO: 162 - protein, 320 aa, Paracoccus denitrificans DSM 415; identical to SEQ ID NO: 2

SEQ ID NO: 163 - protein, 320 aa, Paracoccus halophilus CGMCC 1.6117
MWVVPEKEIAGLMTPEAAFDAIESVFASMARRKAYNFPVVREAIGYEDALYGFKGGFDAAALTLGLKAGGYWPNNQKHGIINHQSTVFLFDPDTGRVAAAVGGNLLTALRTAAASAVSIKHLAPKGASVLGMIGAGHQSVFQMKAAARVNKFERVLGWNPHPEMLGRLADTAAELGLPFEAVELDRLGAEADVIIAITSSFAPLLMDGHVKGPTHIAAMGTDTKGKQELDPALVARARLFTDEIAQSVSIGEYQHVIAGNLVQQDAIGELGAVVTGDNPGREGDEVTIFDGTGVGLQDLAVAAAVVELAKQKGVAQRVEI

SEQ ID NO: 164 - protein, 331 aa, Roseovarius tolerans DSM 11457
MMDQKVETQGIVIVGEEICQEVISRADAFSAVEAVFGAMAKGDAYNFPVVREAIGHADALYGFKGGFDKSGLTLGLKAGGYWPGNMEKGLTNHQSTVCLFDPDTGQLSALVGGNYLTALRTAASSSVSIAHLARKDSRVLGMVGAGHQSAFQLRAAAEQRDFDKVVAWNPHPDMLPRLQAVAEELGLAFEGVSQEELGAQADVIITITSAFEPLLMADWIKPGTHIACMGTDTKGKQEVDPVLFQRATVFADEIAQSISIGEAQHAVAQGLIAEGDITPVGAVINGTHAGRASAEEITLFDGTGVGLQDLAVASVAARIARERGLVTPVTL

SEQ ID NO: 165 - protein, 321 aa, Jannaschia pohangensis DSM 19073
MIIVPESAIANLMTADDAFKAVEAVFAAMSRGDAYNFPVIREAIGHADALYGFKSGFDRAGLNLGLKSGGYWPGNADKGLTNHQSTVFLFDADTGKCRAVVGGNLLTALRTAAAAAVSTAHLAREDARVLGIVGAGHQSTFQLRQVAATRDFERVVAWNRSPEKLDRLAKVAAELGLPFEAVSLETLGAQADVIVTIVSAQAPTLLDAHVRPGTHIACMGTDTKGKQEVEAAILARATVFTDEVAQSVTIGEAQHAVGQGLIAKGDVNELGAVINGTHPGRRSGDEITVFDGTGVGLQDLAVAASVVERAIAEGVAVEVDF

SEQ ID NO: 166 - protein, 329 aa, Ruegeria sp. 6PALISEP08
MKDMPDKPLLIVGEDLCQQLVGRAEAFDAVQNVFAAMARGDAYNFPVIREAIGYADALYGFKSGFDRAGQVLGVKSGGYWPGNMDKGLTNHQSTVFLFDPDTGRLSALVGGNYLTAVRTAASSAVSIAHLARKDAKVLGMVGAGHQSTFQLRAAAEQRDFEKVVAWNPHPEMLPRLGEVAAEIGLEFEAVTQEELGAQADVIITITSAFEPLLMKDWIKPGTHLACMGTDTKGKQEVDAALVSHATVFTDEVAQSISIGEAQHAIADGTLTKVRITSIGSVINNDHPGRTSDDEITLFDGTGVGLQDLAVASVAARLADQSGKAERATL

SEQ ID NO: 167 - protein, 321 aa, Mesorhizobium sp. F7
MIVVSERAVAELITQADCLTAVEKVFASMARGSAYNFPVIREAIGHADALYGFKSGFDRESLALGLKSGGFWPGNSQKGLTNHQSTVFLFDADTGRCKAMVGGNLLTALRTAAASAVSIRHLARRDCRVLGMIGAGHQAAFQLRAALDQRCFERIVAWNFHPEMLGRLAEVAGERGIPFEEVSLDRLGAESDVIVTITSSFSPLLKAMQVRPGTHLACMGTDTKGKQEVEAELLAAATVFTDEVAQAVSIGESQHAIGRGLIRESDIIEIGAVITNAHPGRTSDDEITLFDGTGVGLQDLAVASAAVDLAIAKGAAVEVDF

SEQ ID NO: 168 - protein, 334 aa, Neptunomonas antarctica S3-22; identical to SEQ ID NO: 90

SEQ ID NO: 169 - protein, 321 aa, Oceanicola nitratireducens CGMCC 1.7292
MLIVPEREVAGLMTREAAFTAVEQVFAAMANGNAYNFPVVREAIGHEDALYGFKGGFDRTGLALGLKAGGYWPNNLEKRGMINHQSTVFLFDPDTGKARAMVGGNLLTALRTAAASSVSIRHLAREECKVIGMVGAGHQATFQLRAALEQRAFEKVIGWNMHPEMLPNIEKVAAEAGLPFEAVELDGLRAADVIISITSSFDAILTADHVAPGTHIACMGTDTKGKQEVSPELLSKATVFTDEVAQSVSIGEAQHAVALGLIREADISQLGAVIDGTHPGRQSDEEITLFDGTGVGLQDLAVAAAVVDLAVEKGIAIEVDF

SEQ ID NO: 170 - protein, 321 aa, Sinorhizobium fredii CCBAU 25509
MIIVPENQIAGLMTPADCLVAVEEVFASMAKRSAYNFPVIREAIGYADALYGFKSGFDRSNLALGLKSGGFWPNNVQIGLANHQSSVFLFDADTGKCRAVVGGNLLTALRTAAASAISIKHLARKDAKVLGMIGAGHQSAFQLRAAVEQRSFEKILAWNLHPEMLSRLAEVAMELKLPFKIVDLERLGAESDVIISITSSFAPILKASQVRPGTHLACMGTDTKGKQEMEAELVAAATVFTDEVAQAVTIGECQHAIEKKLLSRDDITELGAVITGRHPGRSSPDEITLFDGTGVALQDLAVASAAVAHAVSRGTAIEVDF

SEQ ID NO: 171 - protein, 321 aa, Leisingera sp. ANG-M6
MYIVPEKAIADLVTREASFDAVEKVFAAMAAGDAYNFPVVREAIGHEDALYGFKGGFDRAGLTLGLKAGGYWPNNLEKRGLINHQSTVFLFDPDTGKVKAMVGGNLLTALRTAAASSVSIKHLARQDAKVIGMIGAGHQATFQLRAALEQRQFEKVIGWNYHPEMLPNIEKVAAEAGLPFEAVDLPGMTEADVIISITSAFAPSLMADHVSPGTHVACMGTDTKGKQEVEAELLVKASVFTDEVAQSITIGEAQHAVAQGLIQESDVAQIGAVINGTNPGRTSDDQITLFDGTGVGLQDLAVAASVVEVAVEKGIAIEVDF

SEQ ID NO: 172 - protein, 321 aa, Leisingera sp. ANG-M7
MYIVPEKAIADLVTREASFDAVEKVFAAMASGDAYNFPVVREAIGHEDALYGFKGGFDRAGLTLGLKAGGYWPNNLEKRGLINHQSTVFLFDPDTGKVKAMVGGNLLTALRTAAASSVSIKHLARQDAKVIGMIGAGHQATFQLRAALEQRQFEKVIGWNYHPEMLPNIEKVAAEAGVPFEAVELEGMREADVIISITSAFAPSLMADHVSPGTHIACMGTDTKGKQEVEAELLVKSSVFTDEVAQSISIGEAQHAVAQGLIQESDVAQIGAVINGTNPGRTSDDQITLFDGTGVGLQDLAVAASVVEVAVEKGIAIEVDF

SEQ ID NO: 173 - protein, 321 aa, Loktanella maricola DSM 29128
MIVVPEKEIAGLLTRADAFDAVEKVFASMSKGSAYNFPVIREAIGYEDALYGFKGGFDNTGMALGLKAGGYWPNNLEKHGEINHQSTVFLFDPDTGKVKAMVGGNLLTALRTAAASSVSIKHLARKDAKVMGMVGAGHQATFQLRAALEQREFEKVIGWNYHPEMLPNIEKVADEAGVPFEAVELDGLVEADVVISITSTFAPTIMANHIAPGTHIACMGTDTKGKQEVEAALLAQTTVFTDEVAQSISIGEAQHAIAAGLIQQSDVNELGAVINGTHPGRTSDDEITLFDGTGVGLQDLAVASSIVDLAVEKGIATIVEF

SEQ ID NO: 174 - protein, 321 aa, Loktanella sediminum DSM 28715
MIIVPEREIAGLMTRKAAFDAVEKVFAAMSAGDAYNFPVVREAIGHEDALYGFKGGFDQAGLTLGLKAGGYWPNNLEKRNLINHQSTVFLFDPDTGKAKAMVGGNLLTALRTAAASSVSIKHLARKDAKVIGMVGAGHQATFQLRAALEQRDFEKVIGWNLHPEMLPNIEKVAEEAGLPFEAVDLSGMTEADVIISITSSFAPSLMADHVSSGTHIACMGTDTKGKKEVEAALLETATVFTDEVAQSISIGEAQHAIAEGLISQNDVNELGAVINGTHAGRIDEDQITLFDGTGVGLQDLAVAASVVDLAAAKGIAIEVDF

SEQ ID NO: 175 - protein, 321 aa, Tateyamaria sp. ANG-S1
MLIVPEKDIADLMTRQAAFDAVEQVFAAMAAEDAYNFPVVREAIGHEDALYGFKGGFDRAGATLGLKAGGYWPHNLEKRDLINHQSTVFLFDPDTGKPAAMVGGNLLTALRTAAASSVSIKHLARPDAKVLGMIGAGHQATFQLRAALEQRDFERVIGWNYHPDMLPNIAKVAEEAGLPFEAVDLPGMVDADVIISITSAFAPSLMADHVSPGTHIACMGTDTKGKQEVEAALFARATVFTDEVAQSVSIGEAQHAIAAELIEASDIHQIGAVINGAHPGRSGDTDITLFDGTGVGLQDLAVAARVVDLAEKKGIAIHVDF

SEQ ID NO: 176 - protein, 321 aa, Labrenzia alexandrii CECT 5112
MIIVPEKEIAALLGRAEAFEAVESVFAAMSSGVAYNFPVIREAIGHADALYGFKSGFDRSSLALGLKSGGYWPGNADNGLTNHQSTVFLFDADTGKARAVVGGNLLTALRTAAASAVSIKHLARKDAKVLGMIGAGHQSAFQMRAAVEQRSFEKVIGWNLHPEMLSRLEETAAELDLPFEAVDLDRLGAEADVIISITSSFDPILKVSQVTPGTHLACMGTDTKGKQEVEAELVAKATVFTDEVAQSSTIGECQNAVASGLISESDINEIGAVINGNHKGRTSVEEITLFDGTGVGLQDLAVASAVVDLAVEKGIAISVDF

SEQ ID NO: 177 - protein, 338 aa, Roseovarius litoreus DSM 28249
MNDLSAQAPKAAQAGNTVTIVPEAEIAGLMTPEAAFDAVEATFAAMARGDAYNFPVIREAIGHADALYGFKSGFDRESLALGLKSGGYWPGNEARGLTNHQSTVILFDADTGRPSALVGGNLLTALRTAAASAVSIRYLARQDAKVLGMIGAGHQSAFQMRAAVQQRSFEKVVGWNYHPEMLSRLADTAAELGLPFEAVTLEELGAQADVIVTITSSFAPSLLDAHVRPGTHLACMGTDTKGKQEVEAGLLARARVFTDEVAQSVTLGEAQHAVAEGLTSADDITQLGAVINGTHPGRTSDQEITMFDGTGVGLQDLAVAAAVVRLAREQGVASQVVL

SEQ ID NO: 178 - protein, 321 aa, Labrenzia sp. CP4
MIIVPEKEIAGLIGRQESFDAVESVFAAMAGGAAYNFPVIREAIGHADALYGFKSGFDRSSLALGLKSGGYWPGNMAKGLTNHQSTVFLFDADTGKAKAVVGGNLLTALRTAAASAVSIKHLARKDAKVLGMIGAGHQSAFQMRAAVEQRDFEKVLGWNLHPEMLVRLEETANELGLPYESVDLARLGTEADVIISITSSFDPILMEEHVSPGTHIACMGTDTKGKQEVDVALVAKAKLFTDEVAQSATIGECQHAVASGIVSEDNIIEIGAVINGNHPGRTSQSDITLFDGTGVGLQDLAVASAAVDLAIQKGVAIEVDF

SEQ ID NO: 179 - protein, 321 aa, Rhizobium sp. N541; identical to SEQ ID NO: 136

SEQ ID NO: 180 - protein, 320 aa, Paracoccus sp. MKU1
MLVVAEKEIAGLMTPEAAFEAIEAVFASMARRKAYNFPVVREAIGHEDALYGFKGGFDASALTLGLKAGGYWPLNQKHNLINHQSTVFLFDPDTGRVSAAVGGNLLTALRTAAASAVSIKYLAPKGAKVLGMIGAGHQSAFQMRAAANVHRFEKVIGWNPHPEMLGRLADTAAELGLPFEAVDLPRLGAEADVIISITSSFSPLLMNEHVKGPTHIAAMGTDTKGKQELDPALVARARIFTDEVAQSVSIGECQHAIASKLIAEEQIGELGAVVAGDNPGRGDAEVTLFDGTGVGLQDLAVAKAVVELAKHKGVAQEVEI

SEQ ID NO: 181 - protein, 321 aa, Pseudoruegeria marinistellae SF-16
MLIVPEREIANLMTREAAFEAVQKVFAAMASGDAYNFPVVREAIGHEDALYGFKGGFDRAGLTLGLKAGGYWPNNLEKHGMINHQSTVFLFDPDTGRATAMVGGNLLTALRTAAASSVSIAHLAREDARVIGMIGAGHQAKFQLRAALEQRSFEKVIGWNLHPEMLPNLEEVASEAGLPFEAVELDGIRDADVIISITSSFDAILTADQVSPGTHIACMGTDTKGKQEVDPALLARATVFTDEVAQSISIGEAQHAIASGLIAENDIAQLGSVINGTHPGRTSAEQITLFDGTGVGLQDLAVAAAVVDLAARNGSAIEVDF

SEQ ID NO: 182 - protein, 321 aa, Ruegeria conchae DSM 29317
MIIVPEKEIGALLGRNESYEAIEQVFAAMAAGDAYNFPVVREAIGHADALYGFKGGFDRAGMTLGLKAGGYWPNNLETHGLINHQSTVFLFDPDTGRVKAIVGGNLLTALRTAAASSVSINHLARKDAKVIGMVGAGHQAKFQLRAALEQREFEKVIGWNLHPDMLPNIEEVASEAGLPFEAVELPGMVEADVIITITSSFAPTLMSDHVSDGTHVACMGTDTVGKQEVGVDLINRATVFTDEVAQSITLGECQHAVASGSKTETDIRQIGEVINGTHPGRQSDQEVTLFDGTGVGLQDLAVASAVVELAVEQGIAIEVDF

SEQ ID NO: 183 - protein, 321 aa, Labrenzia sp. C1B10
MIIVPEKEIAGLIGRQESFDAVESVFAAMAGGAAYNFPVIREAIGHADALYGFKSGFDRSSLALGLKSGGYWPGNMAKGLTNHQSTVFLFDADTGKAKAVVGGNLLTALRTAAASAVSIKHLARKDAKVLGMIGAGHQSAFQMRAAAEQRDFEKVLGWNLHPEMLVRLEETANELGLPYESVDLARLGAEADVIISITSSFDPILMEEHVSPGTHIACMGTDTKGKQEVDVALVAKAKLFTDEVAQSATIGECQHAVASGIVSEDNIIEIGAVINGNHPGRTSQSDITLFDGTGVGLQDLAVASAAVDLAIQKGVAIEVDF

SEQ ID NO: 184 - protein, 321 aa, Methylobacterium radiotolerans NDB3P7
MIIVPEHAIDGLLTEAECFGAVEQVFASMARRRAGNFPVVREAIGHADALYGFKSGFDRDSLALGLKAGGFWPGNAAKGLTNHQSTVFLFDADTGRCRAVVGGNLLTALRTAAACAISIRHLAREGARVLGMIGAGHQSAFQLRAALAQRPFERVLAWNLHPGMFGRMEAVARERGVPFEVVDLDRLGAEADVVVTITSSFAPILKAAQVRPGTHVACMGTDTRGKQEVEAELLAAATVFTDEVAQSVSLGEAQHAVARGLLAADSIVEIGAVINGDHPGRVSDAEITVFDGTGVGLQDLAVAAVAVDRALAKGLATEVGF

SEQ ID NO: 185 - protein, 345 aa, Colwellia psychrerythraea 34H
MSDSKENHAPENHSHKNSLPVNKGVSVVSEAVCQEVMGRADAFTAVENVFSAMAKNTAYNFPVIREAIGHADALYGFKSGFDRDGMVLGLKSGGYWPGNVQKDLTNHQSTVILFDPDTGQLKSLVGGNYLTAVRTAASSAVSIAHLARKDSKVLGMVGAGHQSTFQLRAAVEQREFEKIVCWNFHPEQIPKLAAVAEELGLPFESVTREELCAQADVIITITSAFEALIDKDWIKPGTHIACMGTDTVGKQEVDAKLLAVAKVFTDELAQSITLGEAQHAIAQKLIQQSDIVPIGEVINGTKTGRTSAEDITLFDGTGVGLQDLAVASVAAELAEAKGQVTYFNL

SEQ ID NO: 186 - protein, 333 aa, Psychrobacter arcticus 273-4
MSEANSVNSNEGLLIVSEDACKSVIDRPSAFIAVENVFASMSRGDAYNFPVIREAIGYADALYGFKSGFDRAGKSLGLKSGGYWPGNAAKGLTNHQSTIFLFNPDNGKLRALVGGNYLTAVRTAAASAVSIAHLARKDSKVLGMVGAGHQSTFQLRAALEQRSFEKVVAWNKNKDRLKNLQAVAEELGVPFEAVEREQLCSEADVIITITSAFEPLLMKEWIKPGTHIACMGTDTVGKQEVDVNLVASATVFTDEIAQSISLGEAQHAIKSGAIKESDITTLGDVINGDHPGRSSDDEITLFDGTGVGLQDLAVASAAAKLALEKGEAQHISL

SEQ ID NO: 187 - protein, 334 aa, Roseovarius sp. 217
MMNTQNEVSADGFVIVGEEICQKIISRADAFGAVEAVFAAMARGDAYNFPVVREAIGHADALYGFKGGFDRSGLSLGLKAGGYWPGNMDKGLTNHQSTVFLFDPDTGRLSALVGGNYLTALRTAASSSVSIAHLARNDSKVLGMVGAGHQSTFQLRAAVEQRAFEKVVAWNPHPDMLPRLGAVAEELGLEFEAVTQEELGAQADVIITITSAFEPLMMADWVKPGTHIACMGTDTKGKQEVDPALFQRAAVFADEIAQSISIGEAQHAVGKGLIAEADITPIGAVINGTHTGRSNAEEITLFDGTGVGLQDLAVASVAAKLAREQGLVTPITLG

SEQ ID NO: 188 - protein, 334 aa, Marinobacter sp. ELB17
METPSEALIQPHQILIISEDTCQKVIGRPEAFQAVESVFSSMAKGSAHNFPVVREAIGHAGALYGFKSGFDREGLVLGVKAGGYWPSNVVKGLTNHQSTVALFDPNTGQLKALVGGNYLTAIRTAASSAVSIAHLARKNAKVLGMIGAGFQSTFQLRAAIEQRDFEKVVAWNTHPEHLTRLADVCREHDLPFEAVSLQALGAQSDVIITITSASEPLLQAGWIKPGTHLACMGTDTKGKQEIDHRLLAQATVFTDEIDQSISIGEAQHAVAARVLRAEQITPIGEVINGSHQGRQSEQEITLFDGTGVGLQDLAVASAAASIAEARGLVQRVTL

SEQ ID NO: 189 - protein, 321 aa, Rhizobium leguminosarum bv. trifolii WSM597
MIIVPESAIGELVSLGDCVDAVEKTFVSMAERSAHNFPVVREAVGYADALFGFKSGFDREGLALGLKAGGFWPNNSDKGLTNHQSTVFLFDPETGRCRAVVGGNLLTALRTAAASAISIKHLARRDAKVLGMVGAGHQASFQLRAAVQQRQFEKVVAWNYHPEMLPKLAAVAKELAVPFEAVDLERLGDEADVIITITSSFQPILKASQIRPGTHLACMGTDTKGKQEVDPALVAAATLFTDEIAQAISIGECQHAVAQGMIAPIDIAEIGAVINGQESGRTSPEEVTLFDGTGVGLQDLAVAQAAVELALARGIAVEVDF

SEQ ID NO: 190 - protein, 321 aa, Artificial Sequence
  synthetic peptide
  MISC_FEATURE (1)..(321): pMeth_A285
MYIVPEQEIADLMTRKAAFDAVEKVFAAMAAGDAYNFPVVREAIGHEDALYGFKGGFDRAGLTLGLKAGGYWPNNLEKRGLINHQSTVFLFDPDTGKVKAMVGGNLLTALRTAAASSVSIKHLARKDAKVIGMIGAGHQAKFQLRAALEQREFEKVIGWNLHPEMLPNLQEVADEAGLPFEAVELEGLREADVIISVTSSFDAILKVDQVSPGTHIACMGTDTKGKQEVDPQLLVTADVFTDEIAQSVSIGEAQHAVAQGLIKEADVAQIGAVINGTNPGRTSDGQITLFDGTGVGLQDLAVAASVVERAVEAGIAIEVDF

SEQ ID NO: 191 - protein, 325 aa, Roseobacter litoralis Och 149
MSKGLLIVGEDMCAEVVSSADAFTAVEAVFGAMAKGDAYNFPVIREAIGYADALYGFKSGFDKAGKTLGVKSGGYWPGNMDKGLTNHQSTIFLFDPDTGMLEALVGGNYLTAVRTAASSSVSIAHLARKDAKVLGMVGAGHQSTFQLRAAAEQRSFEKVVAWNPHPDMLPRLGAVAEELGLEFEAVTQEELGAQADVIITITSAFEPLLMKDWIKPGTHIACMGTDTKGKQEVDPELLASATVFADEIAQSITIGEAQHAVASGHLSESDITPIGAVINGTHAGRSSDQEITLFDGTGVGLQDLAVASVAAREAESRGKATRIAL

SEQ ID NO: 192 - protein, 321 aa, Octadecabacter antarcticus 307
MYIVPESAIADILTRPDAFDAVEKVFAAMSAGDAYNFPVIREAIGHEEALYGFKGGFDGVGKSLGLKAGGYWPHNLEKRGIINHQSTVFLFDPDTGKVAAMVGGNLLTALRTAAASSVSIKHLARKDAKVMGMIGAGHQAKFQLRHALETHNFEKVIGWNYHPEMLPSLAEVAAEFDLPFEAASLKGMVEADVVISMTSSFNPIFGAAHISDGTHIACMGTDTVGKQECDTDLIVKATIFTDEVAQSVTLGETQHAVAAGLKSRDDIFELGAVINGTHAGRKSENEITLFDGTGVGLQDLAVSASIVEIAKAKGIGMEVDF

SEQ ID NO: 193 - protein, 321 aa, Methylopila sp. M107
MLIVPENKVAELINTAECFSAVENVFASMASKSANNFPVVREAIGHADALYGFKSGFDRETLALGVKSGGFWPGNAARGLVNHQSSIFLFDADTGRCRAVVGGNLITAIRTAAASAVSIKHLARKDAKTIGMIGAGHQSAFQLRAALEQRPFDRVLGWNVEPKMLQRLRDVADERGVAFEAVGLDRLGAEADVIITITSSFAPILKASHIRPGIHLACMGTDTRGKQEVEAELTASAILFTDEIVQAVTIGECQHAVAAGLVSQDEIAELGAVINGSDPGRRSDEEITLFDGTGVGLQDLAVATRVVDRAIETGAAIEVEY

SEQ ID NO: 194 - protein, 321 aa, Loktanella sp. SE62
MIIVPEAAIADLITRADAYRAVENVFASMSKGRAYNFPVIREAIGHADALYGFKSGFDRDGLALGMKSGGYWPRNADNGLTNHQSTVFLFDADTGKCRAVVGGNLLTALRTAAASAVSINHLARQDAKVLGMIGAGHQSAFQLRAAVEQRDFDRIVGWNYHPDMLPRLAKVAAEVGLPFEAVSLDELGAQADVIISITSAFAPSLMDADVRPGTHIACMGTDTKGKQELDPALLARATIFTDEIAQSVTIGEAQHAISAKLITESDISEIGAVINGTHPGRSDAEEITIFDGTGVGLQDLAVAAAVVDLAVAKGVATEVDF

SEQ ID NO: 195 - protein, 321 aa, Phaeobacter gallaeciensis ANG1; identical to SEQ ID NO: 89

SEQ ID NO: 196 - protein, 320 aa, Rhodobaca barguzinensis DSM 19920
MWIVPESAIPGLVDEQSAFDAIEATFAAMSRGDAYNFPVVREALGEGRQYGFKSGLDRVGALLGVKAGGYFPGNAERGIPNHQSTVYLFDPDSGKPTAMVGGNLLTALRTAAASAISIKHLARADSEVLGMVGAGHQSAFQMRAAVRARGFKKVIGWNYHPEMLSRLADTAAELGLPFEAVSLEQLGAEADVIITITSSFDAIVQDAHIRPGTHLACMGTDTKGKQEVEAAILARASVFTDEVAQSVSIGEAQHAVAAGLLSEGAITEIGAVINGAHAGRAGAEEITVFDGTGVGLQDLAVASRAVELAVERGLAQQIAF

SEQ ID NO: 197 - protein, 330 aa, Mameliella alba DSM 26384
MKDMPETQGLVIVGEAECERLVGRKDAFDAVEAVFGAMAKGDAWNFPVVREAIGYADALYGFKSGFDKAGKVLGVKSGGYWPGNMDKELTNHQSTVFLFDPDTGQLAALVGGNYLTAVRTAASSAVSIAHLARKDAKVLGMVGAGHQSQFQLRAAAEQRDFEKVVAWNPHPEMLPKLGAVAEELGLPFEAVTQEQLGAQADVIITITSAFEPLLMKDWIKPGTHIACMGTDTKGKQEVDAALVAAATVFTDEVAQSISIGEAQHAIAEGFLTEDRITPIGAVINGAHPGRSSDDEITLFDGTGVGLQDLAVASVAARLAEEEGSAQRVSL

SEQ ID NO: 198 - protein, 320 aa, Paracoccus denitrificans DSM 15418; identical to SEQ ID NO: 2

SEQ ID NO: 199 - protein, 328 aa, Ruegeria halocynthiae MOLA R1/13b
MNTQTDGLLIVGEDLCEQLVGRSQAFDAVQSVFAAMASGGARNFPVIREALGYADALYGFKSGFDRDGQVLGVKSGGYWPGNADKGLTNHQSTVFLFDPDTGQLSALVGGNYLTAVRTAASSAVSIAQLARKDAKVLGMVGAGHQSAFQLRAAAEQRDFEKVVAWNPHPDMLPRLAAVADEIGLEFEAVSQQELGAQADVIITITSAFEPLLMKDWIKPGTHLACMGTDTKGKMEVDPELVTSATVFTDEVAQSLTIGEAQHAAGTGALTESAITPIGAVINGDHPGRTGADEITLFDGTGVGLQDLAVASVAARLADEAGLAQRVAL

SEQ ID NO: 200 - protein, 321 aa, Roseivivax isoporae LMG 25204
MIIVPEREIAALMTREAAYDAVETVFAAMAAEDAYNFPVVREAIGHEDALYGFKGGFDRAGKVLGLKAGGYWPNNLERRGIINHQSTVFLFDPDTGRAHAMVGGNLLTALRTAAASSVSINHLARADARVIGMVGAGHQATFQLRAALAQRPFEKVIGWNLHPEMLPNLEKVADEAGLPFEAVDLPGLTEADVIVTITSSFAPSLMAAHVAPGTHLACMGTDTKGKQEVEAALLARATVFTDEVAQSVAIGEAQHAVAQGLIAEGDVTPIGAVINGTHPGRRSDEEITLFDGTGVGLQDLAVAARVVELAVEAGVAVEVDF

SEQ ID NO: 201 - protein, 321 aa, Citreicella thiooxidans DSM 10146
MLIVPEREIGALMTRASAFEAVEKVFAAMASGEAYNFPVIREAIGHEDALYGFKGGFDRAGLTLGLKAGGYWPNNLEKFRVINHQSTVFLFDPDTGKVAAMVGGNLLTALRTAAASSVSIAHLARRDAKVMGMVGAGHQATFQLRAALEQRPFEKVIGWNLHPEMLPNIETVADEAGLPFEAVALEGMREADVIVSITSSFAPSLMAAHVSPGTHLACMGTDTRGKQEVEAALLAVATVFTDEVAQSVSIGEAQHAVAEGLISESDVHQIGAVINGSHPGRRSDEEITLFDGTGVGLQDLAVAAAVVDLAVEKGIAIEVDV

SEQ ID NO: 202 - protein, 321 aa, Citreicella thiooxidans DSM 10146
MLIVPEREIADLMTREAAFSAVEQVFASMAAGDAYNFPVVREAIGHEDALYGFKGGFDRAGLTLGLKAGGYWPHNLEKRGMINHQSTVFLFDPDTGKAKAMVGGNLLTALRTAAASSVSIRHLAREDAKVIGMVGAGHQATFQLRAALEQRDFDKVIGWNLHPEMLPNLEKVAAEAGLPFEAVELEGMRAADVIISITSSFDAILMEEHVAPGTHIACMGTDTKGKQEVAPALLAKAAVFTDEVSQSVSIGEAQHAVAQGLIREADIAQLGAVINGAHPGRRSAEEITLFDGTGVGLQDLAVAAAVVDLAVEKGIAIEVDF

SEQ ID NO: 203 - protein, 321 aa, Antarctobacter heliothermus DSM 11445
MLIVPEREIANLMTREAAFDAVEKVFAAMASGDAYNFPVVREAIGHEDALYGFKGGFDRAGLTLGLKAGGYWPNNLEKRGLINHQSTVFLFDPDTGMVKAMVGGNLLTALRTAAASSVSIKHLARKDAKVLGMIGAGHQATFQLRAALEQRSFDKVIGWNYHPEMLPNIEKVASEAGVPFEAVDLPGMRAADVIISITSAFGPSLMADHVSPGTHVACMGTDTKGKQEVEAALLARAAVFTDEVAQSVSIGEAQHAVAQGLIQDSDIAQLGAVINGSHPGRISDDQITLFDGTGVGLQDLAVAAAVVDLAVAQGIAIEVDF

SEQ ID NO: 204 - protein, 321 aa, Nitratireductor sp. ZZ-1
MHIVSEATCREIMGRDDAFAAVEAIFSAMARGDAYNFPVIREAIGHADALYGFKSGFDRAGMVLGLKSGGYWPGNEKKGLTNHQSTVFLFDPDSGRPMAMVGGNHLTALRTAAASAVSIKHLARRDARVLGMVGAGFQSAFQMRAAVAQRDFDKVVGWNLHPEMLGRLEATAAELGLPFEAVDLDRLGAEADVIITITSSFAPILSLAQVRPGTHLACMGTDTKGKQEVDAALVAAATLFTDEVAQAAAIGECQHAVAAGLVDAAAITPIGAVIDGQHPGRSSPDEITLFDGTGVGLQDLAIASVAVAKAIDKGMAQSVAV

SEQ ID NO: 205 - protein, 321 aa, Rhizobium sp. CNPSO 671
MIIVPERAIADLIGSAECFTAVEHVFAAMARKSAYNFPVIREAIGYADALYGFKSGFDRESLSLGLKSGGFWPKNAESGLTNHQSTVFLFDADTGRCRAVVGGNLLTALRTAAASAISIKYLAREDAKILGIIGAGHQSTFQLRAAVQQRNFEKVVAWNYHPEMLTRLEEVAREIGLPFEAVDLDRLGAEADVIISITSSFSPSLMASQVRPGTHLACMGTDTKGKQEVDAKLVAASSIFTDEVAQAITIGECQHAIADGMIAAEDILEIGAVITGDVKGRRSADDITLFDGTGVGLQDLAVASAVVDLAVSKGVAIEVDF

SEQ ID NO: 206 - protein, 327 aa, Pseudomonas stutzeri NP_8HO
MQTQSPLLIVPEHLIADLISAQDCFAAVEQVFAAMARDTAYNFPVIREAIGHANALYGFKSGFDRESLALGLKSGGFWPRNADRGLTNHQSTIFLFDADTGRCRAVVGGNLLTALRTAAASAVSIRHLARPDARVLGMIGAGHQSTFQLRAALDQRDFDRVVGWNLNPADLDRLAKVADERGIPFQAVDLDQLGAQADVIITITSSFAPILQAAQVRPGTHLACMGTDTKGKQEVEAALLGKASVFTDEVAQSVTIGEAQHAVAQGLIAPDDITQIGAVINGDRPGRVSDDQITLFDGTGVGLQDLAVASAAVDLAVERGIAIAVQI

SEQ ID NO: 207 - protein, 321 aa, Ruegeria sp. ANG-R
MIIVPEKEIATLLGRTESYDAVEQVFAAMAAGDAYNFPVVREAIGHANALYGFKGGFDRAGMTLGLKAGGYWPNNLETHGLINHQSTVFLFDPDTGRVRAVVGGNLLTALRTAAASSVSINHLARKDAKVIGMVGAGHQATYQLRAALEQRSFEKVIGWNLHPEMLPNIANIASEAGLRFEAVELPGMVEADVIITITSSFAPILMSDHVSNGTHVACMGTDTVGKQEVGVDLITRATVFTDEVAQSITLGECQHVVAEGSKTEADIRQIGEVINGTHPGRQTDEEVTLFDGTGVGLQDLAVAGAVVDLAVERGIAIEVDF

SEQ ID NO: 208 - protein, 330 aa, Mameliella alba CGMCC 1.7290; identical to SEQ ID NO: 197

SEQ ID NO: 209 - protein, 321 aa, Pseudorhodobacter antarcticus CGMCC 1.10836
MWIVPEAKIAGLMDRATCFAAIEGVFGAMARGDAYNFPVIREAIGHADALYGFKSGFDRAGLALGLKSGGYWPGNEAKGLTNHQSTVVLFDPDTGRVKALVGGNLLTALRTAAASAVSIKHLARPDAKVLGMVGAGHQSAFQMRAAVEQRAFEKVVGWNFHPEMLDRLAGVAAELGLPFEAVSLDELGAQSDVIITITSSHKPILRSAQVKAGTHIACMGTDTKGKQEVDDLLVARATVFTDEVAQAISIGECQHAIASGLMAEAEIAELGAVINGSHKGRTSAEEVTLFDGTGVGLQDLAVAAAVVELAIAKGIAIEVDF

SEQ ID NO: 210 - protein, 321 aa, Loktanella sp. DSM 29012
MLIVPEREISNLMTRDAAFEAVEKAFAAMASEDAYNFPVIREAIGHEDALYGFKGGFDRAGLTLGLKAGGYWPHNLEKRGEINHQSTVFLFDPDTGKAKAMVGGNLLTALRTAAASSVSIKHLARKDAKVLGMIGAGHQATFQLRAALETHRFKKVIGWNFHPDMLPNIEKVANEAGVPFEAVDLPSMRDADVIISITSAFAPSLMADHVSPGTHVACMGTDTKGKQEVEAALLARASVFTDEVAQSISIGEAQHAIAEGLIKESDVAQLGAVINGTHKGRASDDEITLFDGTGVGLQDLAVAASVVDLAVAKGIAIEVDF

SEQ ID NO: 211 - protein, 320 aa, Paracoccus thiocyanatus ATCC 700171
MLVVPEKQIAGLMTPEAAFEAIEAVFASMARRKARNFPVVREAIGHEDALYGFKGGFDGVALVLGLKAGGYWPLNQKHGLINHQSTVFLFDPDTGRVAAAVGGNLLTALRTAAASAVSIKYLAPKGAKVLGMIGAGHQSTFQMRAAANVHRFEKVIGWNPHPEMLSRLADTATELGLPFEAVELDRLGTEADVIISITSSFSALLMDQHVKGPTHIAAMGTDTKGKQELDPALVARARIYTDEIAQSVSIGECQHAIAAGLIAQEAIRELGAVVAGRGPGRDGAEVTLFDGTGVGLQDLAVAAAVVELAKHKGVAQEVEI

SEQ ID NO: 212 - protein, 321 aa, Rhodovulum sulfidophilum TUT; identical to SEQ ID NO: 129

SEQ ID NO: 213 - protein, 321 aa, Roseovarius sediminilitoris DSM 29439
MFIVPEKEIAALVTRKDNFDAVEQVFASMAGGSAYNFPVIREAIGHADALYGFKSGFDRAALNLGLKSGGYWPGNAEKGLTNHQSTVFLFDADTGKCRAVVGGNLLTALRTAAAAAVSVAHLARKDSKVLGMIGAGHQATFQLQAVAEQRNFEKVVAWNRTSEKLASLQNVADDLGLPFESVSLDELGAQADVIVTIVSSQAAILNDAQVKPGTHIACMGTDTKGKQEVDANLVARATVFTDEIAQSISIGEAQHAIADGSLKQADISEIGAVINGDHPGRTSDDEVTLFDGTGVGLQDLAVASKVVDLAIEKGIAIEVDF

SEQ ID NO: 214 - protein, 321 aa, Leisingera sp. ANG-M1
MYIVPEKEIAGLMTREAAFDAVEKVFAAMASGDAYNFPVVREAIGHEDALYGFKGGFDRAGLTLGLKAGGYWPNNLEKRGLINHQSTVFLFDPDTGKAKAMVGGNLLTALRTAAASSVSIKHLARKDAKVIGMIGAGHQAKFQLRAALEQRQFEKVIGWNLHPDMLPNLQEVADEAGLPFEAVELDGMREADVIISITSSFDAILNTAQVSPGTHIACMGTDTKGKQEVDPQLLVAADVFTDEVAQSISIGETQHAVAQGLIQEADVAQIGAVINGTNPGRTSGDQITLFDGTGVGLQDLAVAASVVDLAVEQGIAIEVDF

SEQ ID NO: 215 - protein, 333 aa, Roseovarius azorensis DSM 100674
MMNTHAEATADGFVIVGEDICEKVISRADAFDAVEAVFAAMARGDAYNFPVVREAIGHADALYGFKGGFDRTGLSLGLKAGGYWPGNMARGLTNHQSTVFLFDPDTGRLSALVGGNYLTALRTAASSSVSIAHLAREDSKVLGMVGAGHQSTFQLRAAVEQRDFEKVVAWNPHPEMLPRLGAVAEELGLAFEAVSPEDLGAQADVIITITSAFEPLIMADWIRPGTHIACMGTDTKGKQEVDPALFSRATVFADEVAQSISIGEAQHAVGQGVIAESDITPVGAVINGTHGGRGSDEEITLFDGTGVGLQDLAVAAVAARLAREQGLVTPVTF

SEQ ID NO: 216 - protein, 321 aa, Sulfitobacter pseudonitzschiae DSM 26824
MLIVPEREIANLMTRAAAFDAVEQVFAAMAAGDAYNFPVVREAIGHEDALYGFKGGFDRAGLTLGLKAGGYWPNNLEKRNLINHQSTVFLFDPDTGRARAMVGGNLLTALRTAAASSVSIKHLARKDARVIGMVGAGHQATFQLRAALEQRDFDKVIGWNYHPEMLPNIEKIAREAGVPFQAVDLPGMVEADVIISITSAFSPSLMADHVAPGCHLACMGTDTKGKQEVEAALLARATVFTDEVAQSVSIGEAQHAVAEGLIAESDVHQLGAVINGTHAGRVSDDQITLFDGTGVGLQDLAVAAAVVDLAVAQGIAIEVDF

SEQ ID NO: 217 - protein, 321 aa, Ruegeria sp. CECT 5091
MIIVPEKEIGALLGRKESYSAVEQVFAAMASGDAYNFPVVREAIGHADALYGFKGGFDRAGMTLGLKAGGYWPNNLETHGLINHQSTVFLFDPDTGRVKAIVGGNLLTALRTAAASSVSINHLARKDAKVIGMVGAGHQATFQLRAALEQRDFEKVIGWNLHPEMLPNIEKVANEAGLPFEAVELPGLTEADVIVTITSSFEPTLLSEHVSDGTHVACMGTDTVGKQEVGADLVIRASVFTDEVAQAITLGESQHAVAAGDKAEADIHQIGAVINGTHAGRNSDDEVTLFDGTGVGLQDLAVASAVVDLAVKQGIAIEVDF

SEQ ID NO: 218 - protein, 322 aa, Pseudoruegeria haliotis DSM 29328
MLIVPEREIGNLMTRAAAFDAVEGVFAAMASKNAYNFPVVREAIGYEDALYGFKGGFDRAGKTLGLKAGGYWPNNLEKFDLINHQSTVFLFDPDTGRVKAIVGGNLLTALRTAAASSVSIKHLAREDAKVLGMIGAGHQATFQLRAALEQRSFEKVVGWNYHPEMLPNIEKVAAEAGLPFEAAQLDRLGQEADVVISITSAFAPSLMADHVSPGTHIACMGTDTKGKQELDAALLPRATVFTDEVAQSVSIGEAQHAVAQGLIAQSDVQQIGAVINGTHPGRTSAEEITLFDGTGVGLQDLAVAASVVDLAVQQGIAIEVDF

SEQ ID NO: 219 - protein, 320 aa, Psychrobacter sp. ENNN9_III
MSEANSVHSDEGLLIVSEDACKSVIDRPSAFTAVENVFASMSRGDAYNFPVIREAIGYADALYGFKSGFDRAGKSLGLKSGGYWPGNADKGLTNHQSTIFLFNPDNGKLRALVGGNYLTAVRTAAASAVSIAHLARKDSKVLGMVGAGHQSTFQLRAALEQRNFEKVVAWNNNKDRLKNLQAVAEELGVPFESVEREQLCSEADVIITITSAFEPLLMKEWIKPGTHIACMGTDTVGKQEVDVNLISAATVFTDEIAQSISLGEAQHAIKSSAIKESDITTLGDVINGEHPGRSSDDEITLFDGTGVGLQDLAVASAAAK

SEQ ID NO: 220 - protein, 317 aa, Pararhodobacter aggregans DSM 18938
MLVVPERLIAGLMGPDEAFEAVAEVFRQTAGGAARNFPVVREALGGGRQYGFKSGMGPGALGVKAGGYFPGNAARGITNHQSVVTLFDPETGRPEAMIGGNLLTALRTAAAAAVSIDALARPGARVLGIVGAGHQAAFQLRAAARVRRFERVIAWNRTPERLAGLAAVAEELGLPFEAVPLAGMREAEVIVTITSSPAYALAAAHVSPGTHLACMGTDTIGKQEVEPALLGAARVFTDEPAQSVTLGEAQHAVAQGLLDPARIVPLGAVLTGEAPGREDPDQITLYDGTGVGLQDLAVAARVLALAKARGLAIPVEI

SEQ ID NO: 221 - protein, 321 aa, Rhodovulum kholense DSM 19783
MFVVPESEIAGLVSPAQCFEAVEAVFSAMARDEAYNFPVIREAIGHADALYGFKSGFDRAGKVLGLKSGGYWPGNVEKGLTNHQSTVVLFDPDTGRPAALVGGNLLTALRTAAASAVSIRHLARCDSRVLGLLGAGHQSAFQMRAAVAERPFEKVIGWNYHPEMLPRLAETAVELGLPFEAVSLEDLGAQADVIVTISSSVAAQLLDAHVRPGTHLACMGTDTRGKQEIDAAIFARARVFTDEVAQSVEIGEAQHAVAAGLIGAGDIVQIGAVINGTVPGRQSEDDITLFDGTGVGLQDLAVAARAVAAARAKGVAVEVDL

SEQ ID NO: 222 - protein, 321 aa, Rhizobium yanglingense LMG 19592
MIIVPESAIGELVSLEDCVDAVEKVFVSMAERSAHNFPVVREAIGYADALFGFKSGFDRKGLALGLKAGGFWPNNADKGLTNHQSTVFLFDPETGRCRAVVGGNLLTALRTAAASAVSIKHLARNDAKVLGMVGAGHQASFQLRAAVQQRQFEKVVAWNYHPDMLPKLAAVAEELGIPFEAVNLDRLGAEADVIITITSSFQPILKASQIKPGTHLACMGTDTKGKQEVDVALVAGATLFTDEIAQAISIGECQHAIAQGMIAPIDIAEIGAVINGQKPGRTSPDEITLFDGTGVGLQDLAVAQAAVGLALARGTAVEVDF

SEQ ID NO: 223 - protein, 321 aa, Labrenzia sp. C1B70; identical to SEQ ID NO: 183

SEQ ID NO: 224 - protein, 320 aa, Starkeya novella DSM 506
  MISC_FEATURE (1)..(320): chromosome
MYVVAEKDIAGLMTPEAAFEAIEAVFASMARRQAYNFPVVREAIGHADALYGFKGGFDGAGLALGLKAGGYWPHNQERGLINHQSTVFLFDPDSGRVSAAVGGNLLTALRTAAASAVSIKYLAPKGAKVLGMIGAGHQSAFQMRAAARVHPFEKVIGWNPHPEMLGRLSDTAAELGLPFEAVELERLGEEADVIISITSSFGPLLMDDHVKGPTHIAAMGTDTKGKQELDPGLVARARLFTDEIAQSVSIGEYQHAVAQGLITQDRIGELGAVVTGDDAGRGDAEVTIFDGTGVGLQDLAVAAKVVELAKQKGIAQQVEV

SEQ ID NO: 225 - protein, 321 aa, Ruegeria mobilis 45A6
MYIVPERAIADLMTRDAAFDAVEKVFAAMAAGDAYNFPVVREAIGHEDALYGFKGGFDRAGLSLGLKAGGYWPNNLEKRGLINHQSTVFLFDPDTGKVRAMVGGNLLTALRTAAASSVSIKHLAREDAKVIGMIGAGHQAKFQLRAALEQRDFDKVIGWNLHPEMLPNLEEIATEAGLPFEAVELDGLKEADVIISITSSFDAILKADQVSPGTHIACMGTDTKGKQEVDPQLLVRATVFTDEVAQSTSIGEAQHAVAQGLIAEADVAQLGAVINGAHPGRSSAEQITLFDGTGVGLQDLAVAASVVELVVKKGIAIEVDF

SEQ ID NO: 226 - protein, 321 aa, Oceaniovalibus guishaninsula JLT2003
MIIVPEAAIANLVTPEASFAAVEKVFASMAAKSAYNFPVIREAIGHADALYGFKSGFDRAALNLGLKSGGYWPGNADKGLTNHQSTVFLFDADTGRCRAVVGGNLLTALRTAAAAAVSVAHLARRDAKVLGIVGAGHQAAFQLRAVAAQRPFERVVAWNRSPEKLSGLREVAEGLGLAFETVSLDDLGAQADVIVTITSSFDAILGADQVRPGTHLACMGTDTKGKQEVDAALLGRATVFTDEIAQSTTIGEAQHAIADLTLRLEDIVELGAVINGDHPGRSSDDEITLFDGTGVGLQDLAVAAAVVDLAVERGVATEVEF

SEQ ID NO: 227 - protein, 321 aa, Loktanella vestfoldensis DSM 16212
MIIVPEREIAGLLGRADAYMAVEAVFAAMASGDARNFPVIREAIGHADALYGFKSGFDRAGLALGLKSGGYWPGNAAKGLTNHQSSVFLFDADTGKCRAVVGGNLLTALRTAAAAAVSINHLARVDARVLGIVGAGHQSVFQLRAALEQRDFTRVVAWNRDPAKLARLSDVAAEHGLPFAAVSLAELGAAADVIITIVSAHEPLLMDAHIRPGTHISCMGTDTKGKQEIDAAIFARASVFTDEIAQSTSIGEAQHAVAAGIISADRITALGAVINGTHQGRTSADEITIFDGTGVGLQDLAVASAVVDLAVTQGVATIVDF

SEQ ID NO: 228 - protein, 321 aa, Rhizobium etli bv. mimosae Mim1
MIIVPESAIGELVSLEDCVDAVEKVFVSMAERSAHNFPVVREAIGYQDALFGFKSGFDREGLALGLKAGGFWPNNADKRLTNHQSTVFLFDPETGRCRAVVGGNLLTALRTAAASAVSIKHLARRDAKVLGMVGAGHQASFQLRAAMQQRPFEKVVAWNYHPEMLPKLAAVAQELAVPFEAVDLDRLGGEADVIITITSSFQPILKALQIKPGTHMACMGTDTKGKQEVDAALVAEATLFTDEIAQAISIGECQHAVARGMIAPIDIVEIGAVINGQQPGRTSPDQITLFDGTGVGLQDLAVAQAAVGLALARGMAVEVDF

SEQ ID NO: 229 - protein, 321 aa, Methylobacterium komagatae DSM 19563
MIIVPENRIDGLLTEADCFTAVEKVFASMARRTAGNFPVVREAIGHADALYGFKSGFDRESLALGLKAGGFWPGNAAKGLTNHQSTVFLFDADTGRCRAVVGGNLLTALRTAAASAISIKHLARKDARVLGMIGAGHQSAFQLRAALAQRPFERVLAWNLHPGMFGRMEAVAREHGVPFEVAELDRLGAEADAIVTITSSFAPILKASHVKPGTHIACMGTDTKGKQEVEAELLAAATVFTDEVAQSVSIGEAQHAIGRGLLTEGAIVEIGAVINGDHPGRTSDEEITLFDGTGVGLQDLAVASAAVDLAVAKGLAVEVEF

SEQ ID NO: 230 - protein, 321 aa, Rhizobium tropici YR635
MIIVPETEIAGLVTPADCFRAVEGVFASMADKSAYNFPVIREAIGHADALYGFKSGFDRKGLALGLKAGGFWPNNVHRGLTNHQSTVFLFDADTGKCRAVVGGNLLTALRTAAASAISIKYLARKDAKVLGMIGAGHQATFQLRAALAQRSFERIVGWNLHPDMLSRLEEVAKEEGLPFEAVDLDRLGAEADVIISITSSFAPMLKASQVRAGTHLACMGTDTKGKQEVEAEILAAAAVFTDEVAQAVTIGESQHAIERGLIREEAIVEIGAVINGTHPGRTSADQITLFDGTGVGLQDLAVASAAVELALAKGVAIEVDF

SEQ ID NO: 231 - protein, 321 aa, Aurantimonas altamirensis DSM 21988
MIIVPERDIAGLIGPADCFVAVEGVFAAMARRTARNFPVVREALGHADALYGFKSGFDGESLALGLKSGGFWPGNMARGLTNHQSAVFLFDADTGQCRAIVGGNRLTALRTAAASAISIKYLARQDARTLGIIGAGHQSTFQLEAALEQRAFEKIVGWNVEPEMLSKLEEVAARRGLPFERVDLDGLGAQADVIITITSSFAPILKVAQVRPGTHIACMGTDTVGKQEVEAELVARASVFTDEVAQAVTLGESQHAVAAGLVDAGSIVEIGQVVTGGHAGRTTPEEITLFDGTGVGLQDLAVASAIVDLAVRKGIATEVEF

SEQ ID NO: 232 - protein, 321 aa, Sulfitobacter sp. MCCC 1A00686; identical to SEQ ID NO: 216

SEQ ID NO: 233 - protein, 321 aa, Methylobacterium sp. 13MFTsu3.1M2
MIIVPEHAIDGLLTEAECFTAVEQVFASMARRRAGNFPVVREAIGHADALYGFKSGFDRDSLALGLKAGGFWPGNAAKGLTNHQSTVFLFDADTGRCRAVVGGNLLTALRTAAACAISVRHLARKDARVLGMIGAGHQSAFQLRAALAQRPFEGVLAWNLHPGMFGRMEAVAREHGVPFEAVDLDRLGSEADVVVTITSSFAPILKAAQVRPGTHLACMGTDTRGKQEVEAELLAGATVFTDEVAQSVSIGEAQHAVARGLLAADSIVEIGAVINGDHPGRVSESEITLFDGTGVGLQDLAVAAVAVDRAVAKGLATEVDV

SEQ ID NO: 234 - protein, 321 aa, Methylobacterium sp. 275MFSha3.1
MIIVPEHAIDGLLTEAECFTAVEQVFASMARRRAGNFPVVREAIGHADALYGFKSGFDRDSLALGLKAGGFWPGNAAKGLTNHQSTVFLFDADTGRCRAVVGGNLLTALRTAAACAISVRHLARKDARVLGMIGAGHQSAFQLRAALAQRPFDRVLAWNLHPGMFGRMEAVAREHGVPFEAVDLDRLGSEADVVVTITSSFAPILKAAQVRPGTHLACMGTDTRGKQEVEAELLAGATVFTDEVAQSVSIGEAQHAVARGLLAADAIVEIGAVINGDHPGRVSESEITLFDGTGVGLQDLAVAAVAVDRAVAKGLATEVDF

SEQ ID NO: 235 - protein, 320 aa, Paracoccus pantotrophus DSM 11073; identical to SEQ ID NO: 110

SEQ ID NO: 236 - protein, 321 aa, Marinovum algicola DSM 10251
MFIVPERDIADLMTREAAFDAVEKVFAAMASGDAYNFPVVREAIGHEDALYGFKGGFDRAGLTLGLKAGGYWPNNLEKRGIINHQSTVFLFDPDTGKAKAMVGGNLLTALRTAAASSVSIKHLARKDAKVIGMVGAGHQAKFQLRAALEQRDFEKVIGWNFHPEMLPNLEEVASEAGLPFEAVALEGLAEADVIISITSSFDAILHADHVAPGTHIACMGTDTKGKQEVETALLGKATVFTDEVAQSISIGEAQHAIESQILRAEDITQVGAVINGTHPGRISDDEITLFDGTGVGLQDLAVAAAVVDLAVAKGLAIEVDF

SEQ ID NO: 237 - protein, 320 aa, Paracoccus versutus DSM 582
MLVVAEKEIAGLMTPEAAFEAIEAIFASMARRKAYNFPVVREAIGHEDALYGFKGGFDASALVLGLKAGGYWPNNQKHNLINHQSTVFLFDPDTGRVTAAVGGNLLTALRTAAASAVSIKYLAPKGAKVLGMIGAGHQSAFQMRAAANVHPFEKVIGWNPHPEMLSRLADTAAELGLPFEAVELDRLGTEADVIISITSSFSPLLMDQHVKGPTHIAAMGTDTKGKQELDPALVARARIFTDEVAQSVSIGECQHAIASGLIREDQIGELGAVVAGDHPGRVDAEVTLFDGTGVGLQDLAVAQKVLEIAKEKGLAQEVEI

SEQ ID NO: 238 - protein, 321 aa, Thalassobius aestuarii DSM 15283
MLIVPERDIADLMTRAAAFEAVEQVFAAMASKDAYNFPVVREAIGHEDALYGFKGGFDRAGLTLGLKAGGYWPNNLEKRGLINHQSTVFLFDPDTGMVRAMVGGNLLTALRTAAASSVSIKHLARKDAKVLGMIGAGHQATFQLRAALEQRDFEKVIGWNYHPEMLPNIATVAEEAGVPFEAVDLEGMREADVIVSITSAFAPSLLADHVSEGTHVACMGTDTKGKQEVEARLLAKATVFTDEVAQSISIGEAQHAVAEGLIRAEDVAELGAVINGTHPGRSSDDQITLFDGTGVGLQDLAVAASVVDLAVEKGVAIEVDF

SEQ ID NO: 239 - protein, 331 aa, Litoreibacter janthinus DSM 26921
MGGMQTDAHKLTIVPEGMIADLLTRQAAFDAVEKVFASMASGEARNFPVVRAALGHEDALYGFKGGFDRAGGVLGLKAGGYWPHNLERRGLINHQSTVLLFDPDSGRVNAMVGGNLLTALRTAAASSVSIKHLARDDAKTLGMIGAGHQSAFQLRAALEIRDFEKVIGWNLHPDKLGSLAQVAKSMGVPFEAVPLERMTEADVIISITSSFNAVLMADHVSPGTHVACMGTDTIGKQEVEVALLAKASVFTDEVAQSVSIGEAQHAISMGLITETDVKQIGAVISGSHVGRQSDDEITLFDGTGVGLQDLAVADSIVKAAVAQGLATVVQL

SEQ ID NO: 240 - protein, 327 aa, Paracoccus sp. 361
MQTQSPLLIVPEHLIADLISAQDCFAAVEQVFAAMARDTAYNFPVIREAIGHADALYGFKSGFDRESLALGLKSGGFWPRNADRGLTNHQSTIFLFDADTGRCRAVVGGNLLTALRTAAASAVSIRHLARWDARVLGMIGAGHQSIFQLRAALDQRDFDRVVGWNLNPADLDRLAKVADERGIPFQAVDLDQLGAQADVIITITSSFAPILQAAQVRPGTHLACMGTDTKGKQEVEAALLGKASVFTDEVAQSVTIGEAQHAVAQGLIAPHDIIQIGAVINGDRPGRVSDDQITLFDGTGVGLQDLAVASAAVDLAVERGIAIAVQI

SEQ ID NO: 241 - protein, 321 aa, Paracoccus homiensis DSM 17862
MLIVPEREIANLMTRQAAFEAVEKVFAAMAAGDAYNFPVVREAIGHEDALYGFKGGFDRAGLTLGLKAGGYWPNNLEKRGLINHQSTVFLFDPDTGKVKAMVGGNLLTALRTAAASSVSIKHLARPDARVLGMVGAGHQATFQLRAALEQRSFDKVIGWNYHPEMLPNIQKVADEAGVPFETVELNGMRQADVIISITSAFAPSLMADHVAPGCHVACMGTDTKGKQEVEAALLARATVFTDEVAQSVQIGEAQHAVAQGLIAESDVTQIGAVINGTHPGRDSDDQITLFDGTGVGLQDLAVAASVVDLAVQQGIAITVDF

SEQ ID NO: 242 - protein, 330 aa, Ponticoccus sp. UMTAT08
MKDMPETQGLVIVGEAECERLVGRKDAFDAVEAVFGAMAKGDAWNFPVVREAIGYADALYGFKSGFDKAGKVLGVKSGGYWPGNMDKGLTNHQSTVFLFDPDTGQLAALVGGNYLTAVRTAASSAVSIAHLARKDAKVLGMVGAGHQSQFQLRAAAEQRDFEKVVAWNPHPEMLPKLGAVAEELGLPFEAVTQEQLGAQADVIITITSAFEPLLMKDWIKPGTHIACMGTDTKGKQEVDAALVAATTVFTDEVAQSISIGEAQHAIAEGSLTEDRITPIGAVINGAHPGRSSDDEITLFDGTGVGLQDLAVASVAARLAEEEGSAKRVSL

SEQ ID NO: 243 - protein, 334 aa, Marinobacter psychrophilus 20041
MDTSSEALTQPHQILIVSEDACQKVIGRHEAFQAVESVFSSMAKGSAYNFPVVREAIGHANALYGFKSGFDREGLVLGVKAGGYWPGNVVQGRTNHQSIVALFDPDTGQLKALVSGNYLTAIRTAASSAVSIAHLARKNAKVLGMIGAGFQSTFQLHAALEQRDFEKVVAWNTHPEHLTRLADVCREHNLPFEAVSLQALGSQSDVIITITSASEPLLQAAWVKPGTHLACMGTDTKGKQEIDHRILAQATVFTDEIDQSISIGEAQHAVTARILSAEQITPIGEVINGLHQGRQSEQEITLFDGTGVGLQDLAVASAAASLAEVRGLAQRVTL

SEQ ID NO: 244 - protein, 321 aa, Methylobacterium sp. Leaf361
MIIVPEHAIDGLLTEAECFTAVEQVFASMARRRAGNFPVVREAIGHADALYGFKSGFDRDSLALGLKAGGFWPGNAAKGLTNHQSTVFLFDADTGRCRAVVGGNLLTALRTAAACAISVRHLARKDARVLGMIGAGHQSAFQLRAALAQRPFERVLAWNLHPGMFGRMEAVAREHGVPFEAVDLDRLGAEADVVVTITSSFAPILKAAQVRPGTHLACMGTDTRGKQEVEAELLAGATVFTDEVAQSVSIGEAQHAVTRGLLAADSIVEIGAVINGDHPGRVSESEITLFDGTGVGLQDLAVAAVAVDRAVAKGLATEVDV

SEQ ID NO: 245 - protein, 332 aa, Aestuariivita boseongensis BS-B2
MGLDGAMTDSAVTIVPEGEIAGLITPQIAFDAVEATFAAMSRKSAYNFPVIRESIGHADALYGFKSGFDRDSLALGLKSGGYWPGNEAKGLTNHQSTVILFDADTGKVKALVGGNLLTALRTAAASAVSIKHLAREDAKVLGMIGAGHQSAFQMRAAVAQRNFEKVVGWNYHPEMLSRLEDTATELGLPFEAVSLEELGAQSDVIISITSSFAPSLLDAHVKPGTHIAAMGTDTKGKQEIDAPILARATVFTDEIAQSITIGEAQHAIADGSLTEGQITEIGAVINGDHAGRTSADEITVFDGTGVGLQDLAVARVAVDLAQAKGVASKVDF

SEQ ID NO: 246 - protein, 321 aa, Paracoccus isoporae DSM 22220
MLIVPEREIADLMTRSAAFDAVEKVFAAMASGDAYNFPVIREAIGHADALYGFKGGFDRAGLTLGLKAGGYWPNNLDQHGIINHQSTVFLFDPDTGRVRAMVGGNLLTALRTAAASSVSIRHLARDDAKVIGMIGAGHQAKFQLRAALEQRDFEKVIGWNLHPEMLPNLEEVAAEAGLPFEAVELDGIREADVIISITSSFDAILMADQVSPGTHIACMGTDTKGKQEVDPALLARATVFTDEVAQSVSIGEAQHAVAAGLIAESDITQIGAVINGTHPGRASAEEITLFDGTGVGLQDLAVAAAVVDLAVQNGVAVEVDF

SEQ ID NO: 247 - protein, 321 aa, Aminobacter aminovorans KCTC 2477
MIIIPERDIAGLVSAADCFVAVEQTFASMAKQSARNFPVIREALGHADALYGFKSGFDRESLALGLKSGGYWPNNAQKGLTNHQSTVFLFDADTGRCRAIVGGNLLTALRTAAASAVSIKHLARPDSKVLGIVGAGHQSTFQLRAALEQRPFEKVLAWNKTPEKLERLASVAREKGLPFQSVSLEQLCGEADVVITITSSFSPVIAEGLIRPGTHLACMGTDTKGKQEVAPEIVAGSTVFTDEVVQSTSIGEAQHAFRLGMIDAAAIIPIGVVVNGDHPGRRSAEEITLFDGTGVGLQDLAVASAAVDLALARGTAIEVDA

SEQ ID NO: 248 - protein, 321 aa, Aminobacter aminovorans KCTC 2477
MIIVPEREIAWLVSDADCFAAVERVFASMAKKSASNLPVVREAIGHLDAIYGVKSGIDREGLVLGLKSGGFWPNNVSRGLTNHQSTIMLFNADTGECRAVVGANLLTALRTAAASAISIKYLSRPDSKVLGIIGAGHQSTFQLKAALQQRAFEKVVGWNIVPQHLARLETVAAEHGLPFERVDLDTLGAQADVIITITSSFDPILRAGQVRPGTHLACMGTDTKGKQEVDARLLANATVFTDEVAQAVTMGETQHAVAEGLVDASAIIAIGAVINGDHSGRVSAEEITLFDGTGVALQDLAVASVAVERAVATGVATTIAF

SEQ ID NO: 249 - protein, 321 aa, Loktanella litorea DSM 29433
MIIVPEREIADLMTRAAAFDAVEKVFAAMAADDAYNFPVVREAIGHEDALYGFKGGFDRAGKVLGLKAGGYWPHNLEKRGEINHQSTVFLFDPDTGKAKAMIGGNLLTALRTAAASSVSIKHLAREDAKVMGMIGAGHQATFQLRAALEQRSFEKVIGWNYHPDMLPNIAKIAEEAGLPFEAVDLPGMAEADVIISITSAFAPSLMADHVSAGTHIACMGTDTKGKQEVEAALLAKATVFTDEVAQSVSIGEAQHAVAEGLIAESDVHQLGAVINGTHPGRVSADDITLFDGTGVGLQDLAVAASVVDLAIEKGIAIEVDF

SEQ ID NO: 250 - protein, 332 aa, Marinobacterium lutimaris DSM 22012
MTTPASGAGNPISIVSEAVCQQIVGRPEAFKAVENVFAAMARGDAYNFPVVREAIGHADALYGFKSGFDRAGMALGVKSGGYWPGNVQKDLTNHQSTVILFDPDTGQLKSLVGGNYLTAVRTAAASAVSIAHLARKDAKVLGMIGAGHQSTFQLRAALEQRDFEKVVAWNPHPEHLPRLAAVCEELRVPFEAVTQQELGAQADVIITITSAFEPLLLKEWIKPGTHIACMGTDTKGKQEVDPALLAAASVFTDEVAQSVLLGEAQHAVASGLIAESDITPIGEVINGTHVGRRDDQEITLFDGTGVGLQDLAVASAAAELADQKGLSQTIVL

SEQ ID NO: 251 - protein, 330 aa, Rubrimonas cliftonensis DSM 15345
MKDAADAAAIAIVSEDVCKEVVSRADAFEAVEKVFAAMARGDAYNFPVIREAIGHADALYGFKSGFDRAGLVLGLKSGGYWPGNAARGLTNHQSTVFLFDPDTGRLRALVGGNHLTALRTAAASAVSIAHLARRDAKVLGMVGAGHQAQFQLRAAAEQRRFERVVAWNYHPDMLPKLGAVAAEIGLPFEAVERERLCAEADVIITIGSSTEPQIMADWVKPGTHLACMGTDTRGKQEVDPALLARATVFTDEVAQSITIGEAQHAVAQGLIGEDAVTPLGRVINGDHPGRTGDDEITLFDGTGVGLQDLAAAAVAMARAVESGKAQTLTL

SEQ ID NO: 252 - protein, 321 aa, Planktotalea frisia SH6-1; identical to SEQ ID NO: 161
  MISC_FEATURE (1)..(321): PFRI

SEQ ID NO: 253 - protein, 321 aa, Aureimonas altamirensis ON-56566
LIIVPERDIAGLIGPADCLAAVEGVFAAMARGTARNFPVVREALGHADALYGFKSGFDAESLALGLKSGGFWPGNMARGLTNHQSTIFLFDADTGQCRAIVGGNRLTALRTAAASAISIKYLAREDARVLGIIGAGHQSTFQLEAALEQRAFEKIVGWNVEPDMLSKLEEVAARRGLPFERVDLDGLGAQADVIITITSSFAPILKAAQVRPGTHIACMGTDTVGKQEVEAELVSRASVFTDEVAQAVTLGESQHAVAAGLVDAGSIVEIGQVVTGAHPGRTSAEEITLFDGTGVGPQDLAVASAVVDLAVRKGIATEVEF

SEQ ID NO: 254 - protein, 334 aa, Marinobacter sp. Hb8
METSSKEPSQPHQILIVNEDACREVIGRHEAFQAVEAVFASMARGGAYNFPVVREAIGHADALYGFKSGFDREALVLGVKSGGYWPGNAARGLTNHQSTVVLFDPDTGRLKALVGGNYLTAVRTAASSAVSIAHLARKDAKVLGMVGAGYQSTFQLKAALEQRAFEKVVAWNAHPEHLTRLAAICEEKGIPFEGVSRQELGAQSDVIITITSAFEPLLDADWIKPGTHLACMGTDTKGKQEVDHKLLAQATVFTDEIAQSISIGEAQHAVAAQILSEDQITPIGEVINGTNPGRQSEADITLFDGTGVGLQDLAVASEAARLAETGGLAQRVTL

SEQ ID NO: 255 - protein, 329 aa, Ruegeria sp. ZGT108
MKDMSDNGLLIVSEDLCQQLVGRKEAFDAVQDVFAAMARGDAYNFPVIREAIGYADALYGFKSGFDRAGQVLGVKSGGYWPGNTEKGLTNHQSTVFLFDPDTGRLSALVGGNYLTAVRTAASAAVSIAHLARRDSKVLGMVGAGHQSTFQLRAAAEHRDFEKVVAWNPHPEMLPRLEGVAHEVGLEFQAVTQEELGAQADVIITITSAFEPLLMKDWIKPGTHLACMGTDTKGKQEVDAMLVAHATVFTDEVAQSITIGETQHAVADGQLTKDQITPIGAVINGDHPGRGSDEEITLFDGTGVGLQDLAVASVAAKLADKAGLAGRATL

SEQ ID NO: 256 - protein, 320 aa, Paracoccus sediminis DSM 26170
MWVVPEHEIAGLMTPEAAFDAVEAVFAAMARGDARNFPVVREALGHEDALYGFKGGFDGAGMTLGLKAGGYWPNNQKHGLINHQSTVFLFDPDTGRVSAAVGGNLLTALRTAAASAVSSKYLAPEGARVLGMIGAGHQSAFQMRAAVRFGQFEKVVGWNPHPAMLSRLADTAAELGLPFEAVDLPQLGADADVIITITSAFEPLLLDGHVTGPTHIAAMGTDTKGKQELDPALVARARLFTDEVAQSVSIGEFQHASAQKTVSADDITALGQVIIGNHPGRGDAQVTIFDGTGVGLQDLAVASAVVELAKQHGKAIQVAI

SEQ ID NO: 257 - protein, 321 aa, Ruegeria scottomollicae DSM 25328
MYIVPERAIADLMTRKAAFDAVEQVFAAMAAGDAYNFPVVREAIGHEDALYGFKGGFDRAGLTLGLKAGGYWPNNLEKRGLINHQSTVFLFDPDTGKVRAMVGGNLLTALRTAAASSVSIKHLAREDAKVIGMIGAGHQAKFQLRAALEQREFDKVIGWNLHPEMLANLEEVATEAGLPFEAVELDGLKEADVIISITSSFDAILKADQVSPGTHIACMGTDTKGKQEVDPELLVRADVFTDEVAQSISIGEAQHAVAQGLIAEADVAQLGAVINGAHPGRTSAEQITLFDGTGVGLQDLAVASSVVELAVKQGIAIEVDF

SEQ ID NO: 258 - protein, 321 aa, Rhizobium leguminosarum CGMCC 1.2553T
MIIVPESAVRDLVSLEDCVNAVEKAFVSMAERSAQNFPVVREAIGYEDALFGFKSGFNREGLALGLKAGGFWPNNASKGLTNHQSTVFLFDPETGRCRAVVGGNLLTALRTAAASAVSIKYLARKDAKVLGMVGAGHQASFQLRAAVQQRAFEKVVAWNFHPEMLPKLAAVADELAIPFEAVELDRLGDEADVIITITSSFQPILKAQQVRPGTHLACMGTDTKGKQEVDAALFASATLFTDEIAQAISIGESQHAIAQGLVAPVDIGEIGAVISGRIPGRSSADQVTLFDGTGVGLQDLAVAQAAVELAIARGTAVEIEI

SEQ ID NO: 259 - protein, 321 aa, Sulfitobacter sp. HI0021
MLIVPEREIANLMTREAAFDAIEKVFAAMASGDAYNFPVVREAIGHEDALYGFKGGFDRAGLSLGLKAGGYWPNNLEKRNLINHQSTVFLFDPDTGKVKAMVGGNLLTALRTAAASSVSIKHLARKNATVIGMVGAGHQATFQLRAALEQRKFEKVIGWNYHPEMLPNIEKVAHEAGVPFEAVDLPGMTEADVIISITSAFSPSLMADHVSPGTHIACMGTDTKGKQEVEAALLARASVFTDEVAQSVSIGEAQHAIAEGLIKDTDVAQLGAVINGTNPGRTSDHQITLFDGTGVGLQDLAVAAKVVDLAVEQGVAIDVDF

SEQ ID NO: 260 - protein, 321 aa, Sulfitobacter sp. HI0076; identical to SEQ ID NO: 259

SEQ ID NO: 261 - protein, 321 aa, Thalassobius mediterraneus CECT 5118; identical to SEQ ID NO: 99

SEQ ID NO: 262 - protein, 332 aa, Rhodobacteriaceae sp. PT6CLA
  MISC_FEATURE (1)..(321): uncultured Rhodobacteriaceae sp. PT6CLA
MNDMTQAQTDGLIIVSEEICQQVIGRQDAFDAVEAVFGAMAKGDAYNFPVIREAIGHADALYGFKSGFDRAGLALGLKSGGYWPGNADKGLTNHQSTVFLFDPDTGKLKALVGGNYLTALRTAAASSVSIAHLARKDAKVLGMVGAGHQSAFQLRAAAEQRDFEKVVAWNPHPEMLPKLGEVATQIGLEFEAVERDQLGAEADVIITITSAFEPLMMASQIKPGTHIACMGTDTVGKQEVDPALLAAATVFTDEVAQSISLGEAQHAIAQGLIAEADITPIGNVINGTHPGRSSADEITLFDGTGVGLQDLAVASVAADLAAKAGTATRVAL

SEQ ID NO: 263 - protein, 321 aa, Sinorhizobium terangae WSM1721
MIIVPENQIAGLITPADCLAAVEGVFASMAKRSAYNFPVIREAIGHADALYGFKSGFDRDSLALGLKSGGFWPNNVQKGLANHQSTVFLFDADTGRCRAVVGGNLLTALRTAAASAVSIKYLARRDAKVLGMIGAGHQSTYQLRAAVEQRPFEKVLAWNLHPEMLSRLEGVARELELPFETVDLDRLGDEADVIISITSSFAPILKASQVRPGTHLACMGTDTKGKQEMDAELLAAATVFTDEVAQAVTIGECQHAIEKGLISRDDIVEIGAVITGRHTGRSSPEEITLFDGTGVGLQDLAVASAAVELALSKGTAIEVDF

SEQ ID NO: 264 - protein, 321 aa, Ruegeria sp. TW15; identical to SEQ ID NO: 182

SEQ ID NO: 265 - protein, 321 aa, Rhizobium sp. BR816
MIIVPENQIAGLITPADCLLAVEGVFASMAERSAYNFPVIREAIGHADALYGFKSGFDRDSLALGLKSGGFWPNNVEKGLANHQSTVFLFDADTGGCRAVVGGNLLTALRTAAASAVSIKYLARNDAKVLGMIGAGHQSTYQLRAAVEQRPFEKVLAWNLHPEMLSRLERIARELELPFETVDLDRLGAESDVIISITSSFAPILKASQVRPGTHLACMGTDTKGKQEVDPELVAAATVFTDEVGQAVTIGECQHAIDKGLISKDDIVEIGAVITGRHKGRSSSEEITLFDGTGVGLQDLAVASAAVELALSKGAAIEVDF

SEQ ID NO: 266 - protein, 334 aa, Glaciecola sp. ANT9081 (cola82)
MIIQNDEMNTDKGITIISEAICEAVVGRPEAFTAVENVFAAMAKGDAYNFPVVREAIGHADALYGFKSGFDRAGMALGVKSGGYWPGNAKKNLTNHQSTIFLFDPDTGQLISLVGGNHLTAMRTAASSAVSIAHLARKDAKVLGMVGAGHQSTFQLRAALEQRKFEKVVAWNLHSADLQRLAKVCEELGLPFEALERKELGAQADVIITITSAFEPLMMKEWIKPGTHIACMGTDTKGKQEVDPELLVAATVFTDEIAQSVSIGEAQHAIASGTIKAEDIVPIGEVINGTHPGRLSDEEITLFDGTGVGLQDLAVAQAAAVLAEKQGLAVSINL

SEQ ID NO: 267 - protein, 321 aa, Paracoccus pantotrophus J40
MWIVPEKEIAGLMTPEAAFDAVQAVFAAMASGKASNFPVVREAIGHEDALYGFKGGFDRSARNLGLKAGGYWPNNQRRELINHQSTVFLFDADTGRVQAAVGGNLLTALRTAAASAVSIKYLARPDAKVLGIVGAGHQSTYQLRAALDQRPFEKVLAWNRTPERLKRLEAAAQEKGLPFKSVTLEQLCRQADVVVTITSSFSPMIAEGLIRPGTHLACMGTDTRGKQEVAPEIVAASTVFTDEVAQSTTIGEAQHAFGMGLLDAAAIVPIGDVINKEHPGRRSAEEITLFDGTGVGIQDLAVASAAVDLAVARGRAVEVEM

SEQ ID NO: 268 - protein, 320 aa, Paracoccus pantotrophus J40; identical to SEQ ID NO: 110

SEQ ID NO: 269 - protein, 321 aa, Marinovum algicola DG 898
MFIVPERDIADLMTREAAFDAVEKVFAAMASGDAYNFPVVREAIGHEDALYGFKGGFDRAGLTLGLKAGGYWPNNLEKRGIINHQSTVFLFDPDTGKAKAMVGGNLLTALRTAAASSVSIKHLARKDAKVIGMVGAGHQAKFQLRAALEQREFEKVIGWNFHPEMLPNLEEVASEAGLPFEAVALEGLTEADVIISITSSFDAILHADHVAPGTHIACMGTDTKGKQEVETALLGKATVFTDEVAQSISIGEAQHAIESQILRAEDITQVGAVINGTHPGRTSDEEITLFDGTGVGLQDLAVAAAVVDLAVAKGLAIEVDF

SEQ ID NO: 270 - protein, 321 aa, Labrenzia alexandrii DFL-11
MIIVPEKEIAALLGRAEAFEAVESVFAAMSSGVAYNFPVIREAIGHADALYGFKSGFDRSSLALGLKSGGYWPGNADKGLTNHQSTVFLFDADTGKAKAVVGGNLLTALRTAAASAVSIKHLARKHAKVLGMIGAGHQSAFQMRAAVEQRSFEKVIGWNLHPEMLSRLEETAAELDLPFEAVDLDRLGAEADVIISITSSFDPILKVSQVTPGTHLACMGTDTKGKQEVEAELVAKATVFTDQVAQSSTIGECQYAVASGLISESDINEIGAVINGNHKGRTSVDEITLFDGTGVGLQDLAVASKVVDLAVEKGIAISVDF

SEQ ID NO: 271 - protein, 321 aa, Methylobacterium sp. 285MFTsu5.1
MIIISEREIATLVSPADCFAAVEGVFASMAKGKAYNFPVVREAIGHADALYGFKSGFDRESLALGLKSGGFWPGNVEKGLTNHQSTIFLFDADTGCCRAIVGGNLLTALRTAASSALSIKYLARPEARVIGMIGAGHQSTFQLSAALDQRRFEKVVGWNIEPSALGRLESVAVERGIPFEAVDLDRLGAEADVIITITSSFAPILKAAQVRPGTHLACMGTDTKGKQEVEAELLAKASVFTDEIAQATSIGEAQHAVAQGLLAATDIVAIGSVINGAHPGRRSPEDITLFDGTGVGLQDLAVASTAVDLAIARGVAREIDF

SEQ ID NO: 272 - protein, 321 aa, Methylobacterium sp. 285MFTsu5.1
MIIVPEHAIDGLLTEAECFTAVEQVFASMARRRAGNFPVVREAIGHADALYGFKSGFDRDSLALGLKAGGFWPGNAAKGLTNHQSTVFLFDADTGRCRAVVGGNLLTALRTAAACAISVRHLARKDARVLGMIGAGHQSAFQLRAALAQRPFERVLAWNLHPGMFGRMEAVAREHGVAFEAVDLDRLGSEADVVVTITSSFAPILKAAQVRPGTHLACMGTDTRGKQEVEAELLAAATVCTDEVAQSVSIGEAQHAVARGLLAADSIVEIGAVINGDHPGRVSESEITLFDGTGVGLQDLAVAAVAVDRAVAKGLATEVDV

SEQ ID NO: 273 - protein, 321 aa, Methylobacterium sp. EUR3 AL-11
MIIVPEHAIDGLLTEAECFTAVEQVFASMARRRAGNFPVVREAIGHADALYGFKSGFDRDSLALGLKAGGFWPGNAAKGLTNHQSTVFLFDADTGRCKAVVGGNLLTALRTAAACAISVRHLARKDARVLGMIGAGHQSAFQLRAALAQRPFERVLAWNLHPGMFGRMEAVARERGVPFEVVDLDRLGAEADVVVTITSSFAPILKAAQVRPGTHVACMGTDTRGKQEVEAELLAAATVFTDEVAQSVSLGEAQHAVARGLLAADSIVEIGAVINGDHPGRVSDAEITVFDGTGVGLQDLAVAAVAVDRAVAKGLATEVDF

SEQ ID NO: 274 - protein, 320 aa, Paracoccus yeei ATCC BAA-599
MLVVAEKEIGGLMTPEAAFEAIEAVFAAMDAGKAYNFPVVREAIGHEDALYGFKGGFDASALTLGLKAGGYWPNNQKHDLINHQSTIFLFDADTGRVAAAVGGNLLTALRTAAASAVSIKYLAPKGARVLGMIGAGHQSAFQMRAAARVHAFEKVIGWNPHPEMLTRLAETAAELGLPFEAVDLDRLGAEADVIVSITSSFSPLLMNEHVRGETHIAAMGTDTKGKQELDPALVARAKLYTDEVAQAVSIGECQHAVAQGLVEAAAITRLGAAVNGTDPGRDGAEITLFDGTGVGLQDLAVAAKVVQLAQAKGIAQTVEI

SEQ ID NO: 275 - protein, 321 aa, Defluviimonas sp. 20V17; identical to SEQ ID NO: 92

SEQ ID NO: 276 - protein, 321 aa, Sphingomonas sp. DC-6
MIIVPEREIAGLISASDCFTAVEQVFASMAKKSAYNFPVIREAIGHADALYGFKSGFDRESLALGLKSGGFWPNNMAKGLTNHQSTVFLFDADTGKCKAVVGGNLLTALRTAAASAVSIKYLARPDSKVLGMIGAGHQSTFQLRAALEQRPFEKVIGWNLHREALSRLEAVAAEKGLPFEAVDLDRLGAEADVIITITSSFDPILEAAQVRPGAHLACMGTDTKGKQEVDAELVAASTVFTDEIAQSITIGEAQHAVAEGLIAAESIIEIGAVINGSHPGRTSEREITLFDGTGVGLQDLAVASAAADLAVSKGVAIEVDF

SEQ ID NO: 277 - protein, 332 aa, Rhodobacteraceae bacterium bin18
  MISC_FEATURE (1)..(332): Alphaproteobacteria (AP)
MADGASAPANELVIVPEGMIPDILTREASFDAVEKVFAAMAAGEARNFPVVREAIGHEDALYGFKGGFDAVGGVLGLKAGGYWPHNLDRRGIINHQSTVFLFDPDTGRVKALVGGNYLTALRTAAASSVSIRHLARKDAKVLGMIGAGHQAKFQLRAAAETHAFEKVIGWNLHPEMLPGLAEVAREVGLPFEAVELPGMSEADVIITITSSFAPTLLADHVSPGTHLACMGTDTKGKQEVEAALLGRARVFCDEVAQSVSIGEAQHAVAEGLLSEGDVTQLGAVINGTHGGRGSDEEITLFDGTGVGLQDLAVADAIVKTAVAQGIATIVPL

SEQ ID NO: 278 - protein, 320 aa, Paracoccus sulfuroxidans CGMCC 1.5364
MYVVPEKEIAGLMTPDAAFEAIEAVFASMARRKAYNFPVVREAIGYEDALYGFKGGFDAAGLSLGLKAGGYWPNNQKHNLINHQSTVFLFDPDTGRVSAAVGGNLLTALRTAAASAVSIKYLAPKGAKVLGMIGAGHQSAFQMRAAARVHNFEKVIGWNPHPEMLTRLADTAAELGLPFEAVELDRLGSEADVIISITSAFSPLLMDSHVKGPTHIAAMGTDTKGKQELDAALVARARVFTDEVAQSISIGEAQHAIAQGLIAEEAINELGAVVTGDHEGRGDAEVTIFDGTGVGLQDLAVAHKSVEIAKQKGVALTVEI

SEQ ID NO: 279 - protein, 330 aa, Marinobacterium sp. AK27
MSTSVNGAGVAIVSEAVCEQIVGRPEAFKAVESVFGAMARGDAYNFPVVREAIGHADALYGFKSGFDRAGMVLGVKSGGYWPGNVQKDLTNHQSTVILFDPDTGRLKALVGGNYLTAVRTAAASAVSIAYLARKDAKVLGMVGAGHQSTFQLRAALEQRAFEKVVAWNPHPEYLSRLAAVCDELRVPFEAVDQQQLGAQADVIITITSAFEPLMMKEWIKPGTHIACMGTDTKGKQEVDPELLAAATLFTDEVAQSISIGEAQHAVASGLISESDITPIGEVINGTHPGRRDDQEITLFDGTGVGLQDLAVASAAANLALEQGLALRIAL

SEQ ID NO: 280 - protein, 321 aa, Yangia pacifica DSM 26894
MLIVPEREIADLMTREAAFAAVEKVFAAMAAGDAYNFPVVREAIGHEDALYGFKGGFDRSGLTLGLKAGGYWPNNLEKRGIINHQSTVFLFDPDTGKARAMVGGNLLTALRTAAASSVSIRHLAREDARVIGMVGAGHQATFQLRAALEQRDFDKVIGWNLHPEMLPNLEKVAAEAGVPFEAVELTGMREADVIISITSSFDAILMAEHVSPGCHIACMGTDTKGKQEVSPALLAKATVFTDEVAQSVSIGEAQHAVAQGLIDESAITQLGAVINGAHPGRRSAEEITLFDGTGVGLQDLAVAAAVVDLAVEKGIAIEVDF

SEQ ID NO: 281 - protein, 321 aa, Shimia haliotis DSM 28453
MLIVPEREIADLMTRDAAFDAVEKVFAAMASGDAYNFPVVREAIGHEDALYGFKGGFDQAGLTLGLKAGGYWPNNLEKRGLINHQSTVFLFDPDTGKAKAMVGGNLLTALRTAAASSVSIKHLARSDSKVIGMVGAGHQATFQLRAALEQRNFEKVIGWNYHPEMLPNIEKVANEAGLPFEAVDLPGLTEADVIISITSAFAPSVMAEHISEGTHIACMGTDTKGKQEVEAALLVKADVFTDEVAQSISIGEAQHAVAQGLIKETDVAQLGAVINGTIAGRTSDDQITLFDGTGVGLQDLAVAASVVDLAVEKGIAIEVDF

SEQ ID NO: 282 - protein, 322 aa, Hasllibacter halocynthiae DSM 29318
MIIVPEAAIADLVDRAAAFDAVEATFAAMASGDARNFPVVREALPGPEEALYGFKGGVDASAEALGLKAGGYWPHNLERRGLINHQSTVFLFDPETGRPTAMVGGNLLTALRTAAASSVSIRHLAREDARVIGMVGAGHQAGFQLRAALEQRPFEKVIGWNLHPEMLPNLEKVAAEAGLPFEAVELEGLRAADVIVTITSSFAPTLMAGHVGPGAHVACMGTDTVGKQEVDPELLKLATVFADEVAQSVTLGEAQHAVGAGTIAEGDLTPIGDVIRGVHPGRTSQEEITLFDGTGVGLQDLAVAAAAVRLAQEKGVAVEVEI

SEQ ID NO: 283 - protein, 321 aa, Oceanicola nitratireducens DSM 29619; identical to SEQ ID NO: 169

SEQ ID NO: 284 - protein, 321 aa, Ruegeria halocynthiae DSM 27839
MIIVPEKEIGALLGRKESYEAIEQVFAAMASGNAYNFPVVREAIGHADALYGFKGGFDQAGMTLGLKAGGYWPNNLETHGLINHQSTVFLFDPDTGRVKAVVGGNLLTALRTAAASSVSINYLARKDAKVIGMVGAGHQAKFQLRAALEQRNFEKVIGWNLHPEMLPNLEEVAAEAGLPFEAVELSGMTEADVIITITSSFAPTLMSDHVSDGTHIACMGTDTIGKQEVGVDLIARASVFADEIAQSITLGECQHAIANGSKAEADIRQVGEVINSTHQGRTSDDEVTLFDGTGVGLQDLAVASAVVDLAVEQGIAIKVDF

SEQ ID NO: 285 - protein, 334 aa, Citreimonas salinaria DSM 26880
MNAPDKTATAANMVTIVPESEIGGLMDAASAFDAVEATFAAMARGDAYNFPVIREAIGHADALYGFKSGFDKAALALGLKSGGYWPGNEARGLTNHQSTVILFDADTGRVKALVGGNLLTALRTAAASAVSIAHLSRKDSKVLGMVGAGHQSAFQMRAACAQRDFDKVVGWNYHPEMLSRLEDTAKELGLPFEAVEREDLCAQADVIITITSSHDAQLMADWVKPGTHVACMGTDTKGKQEVDPALLARASVFTDEVAQSVTLGEAQHAVAQGLIKEADITPIGAVIEGTAKGRTSDDQVTLFDGTGVGLQDLAVAAKVVDLALKAGKAQQVPF

SEQ ID NO: 286 - protein, 321 aa, Ruegeria mobilis S1942
MYIVPERAIADLMTRDAAFDAVEKIFAAMAAGDAYNFPVVREAIGHEDALYGFKGGFDSAGLSLGLKAGGYWPNNLEKRGLINHQSTVFLFDPDTGKVRAMVGGNLLTALRTAAASSVSIKHLAREDAKVIGMIGAGHQAKFQLRAALEQRDFDKVIGWNLHPEMLPNLKEVATEAGLPFEAVELDGLKEADVIISITSSFDAILKADQVSPGTHIACMGTDTKGKQEVDPQLLVRATVFTDEVAQSISIGEAQHAVAQGLITEADVAQLGAVINGAHPGRSSAEQITLFDGTGVGLQDLAVAASVVELAVKKGVAIEVDF

SEQ ID NO: 287 - protein, 321 aa, Leisingera aquaemixtae CECT 8399
MYIVPEKAVADLVTREASFDAVEKVFAAMASGDAYNFPVVREAIGHEDALYGFKGGFDRAGLTLGLKAGGYWPNNLEKRGLINHQSTVFLFDPDTGKVKAMVGGNLLTALRTAAASSVSIKHLARQDAKVIGMIGAGHQAKFQLRAALEQRNFEKVIGWNFHPDMLPNIEKVAAEAGVPFEAVDLPGMRDADVIISITSAFAPSLMADHVSPGTHVACMGTDTKGKQEVEAALLVKSTVFTDEVAQSITIGEAQHAVAQGLIQESDVAQLGAVINGTNPGRTSDDQITLFDGTGVGLQDLAVAASVVEVAVEKGIAIEVDF

SEQ ID NO: 288 - protein, 321 aa, Leisingera aquaemixtae CECT 8399; identical to SEQ ID NO: 287

SEQ ID NO: 289 - protein, 320 aa, Paracoccus halophilus JCM 14014; identical to SEQ ID NO: 163

SEQ ID NO: 290 - protein, 321 aa, Ruegeria sp. ZGT118
MLIVPEREIADLMTREAAFDAVEQVFASMASGDAYNFPVVREAIGHEDALYGFKGGFDRAGLTLGLKAGGYWPNNLEKHGLINHQSTVFLFDPDTGRPTAMVGGNLLTALRTAAASSVSIKHLARTDAKILGMIGAGHQAAFQLRAALEQRNFEKVIGWNYHPEMLPNIEKVAAEAGIPFEAVPLDGMRQADVIISITSAFAPSLMADHVSAGTHVACMGTDTKGKQEVESALLAGAGVFTDEVAQSVTIGEAQHAVAEGLIKESDVAQLGAVINGTHPGRSSDDQITLFDGTGVGLQDLAVAASVVELAVRKGIAIEVDF

SEQ ID NO: 291 - protein, 326 aa, Ruegeria faecimaris DSM 28009
MKSDGLLIVGEDLCEKLVGRQQAFDAVQAVFGAMAKGGAWNFPVIREALGHADVLYGFKSGFDRDGQVLGLKSGGYWPGNAAKGLTNHQSTVFLFDPDTGRLSALVGGNYLTAVRTAASSAVSIAHLARQDARVLGMVGAGHQSTFQLRAAAEQRDFEKVIAWNPHPDMLPRLAAVATEVGLEFEAVSQQELGAQADVIITITSAFEPLLMKDWIKPGTHLACMGTDTKGKQEVDADLVAAATVFTDEVAQSVTIGEAQHAINLGALTEDAIAPIGAVINGDHPGRTSDDQITLFDGTGVGLQDLAVASVAARLAEEADLAQRATL

SEQ ID NO: 292 - protein, 321 aa, Shimia sagamensis DSM 29734
MLIVPEREIADLMTREAAFDAVEKVFAAMAARDAYNFPVVREAIGHEDALYGFKGGFDQAGLTLGLKAGGYWPNNLEKRDLINHQSTVFLFDPDTGKAKAMVGGNLLTALRTAAASSVSIKHLARDDAKVIGMIGAGHQATFQLRAALEQRQFEKVIGWNYHPEMLPNIEKVATEAGLPFEAVKLDGMKEADVIISITSAFAPSLMADHVAPGTHIACMGTDTKGKQEVESALLAKASVFTDEVAQSISIGEAQHAVAEGLIKESDVGEIGAVINGTNPGRTSADQITLFDGTGVGLQDLAVAAAVVDLAVEKGIAIEVDF

SEQ ID NO: 293 - protein, 321 aa, Sulfitobacter sp. HI0027; identical to SEQ ID NO: 259

SEQ ID NO: 294 - protein, 333 aa, Psychrobacter cryohalolentis K5
MSEANSVNSDEGLLIVSEDACKSVIDRPSAFIAVENVFASMSRGDAYNFPVIREAIGYADALYGFKSGFDRAGKSLGLKSGGYWPGNAAKGLTNHQSTIFLFNPDNGKLRALVGGNYLTAVRTAAASAVSIAHLARKDSKVLGMVGAGHQSTFQLRAALEQRNFEKVVAWNKNKDRLKNLQAVAEELGVPFEAVEREQLCSEADVIITITSAFEPLLMKEWIKPGTHIACMGTDTVGKQEVDVNLIAAATVFTDEITQSISLGETQHAIKSGAIKESDITTLGDVINGEHPGRSSDDEITLFDGTGVGLQDLAVASAATKLALEKGEAQHISL

SEQ ID NO: 295 - protein, 321 aa, Rhodobacterales bacterium Y4I
  MISC_FEATURE (1)..(321): scf_1106129324775 genomic scaffold
MYIVPEKAVADLVTREASFDAVEKVFAAMASGDAYNFPVVREAIGHEDALYGFKGGFDRAGLTLGLKAGGYWPNNLEKRGLINHQSTVFLFDPDTGKVKAMVGGNLLTALRTAAASSVSIKHLARQDAKVIGMIGAGHQATFQLRAALEQRPFEKVIGWNYHPEMLPNIEKVAAEAGVPFEAVDLPGMADADVIISITSAFAPSLMADHVSPGTHIACMGTDTKGKQEVEAELLVKATVFTDEVAQSISIGEAQHAVAQGLIQESDVAQIGAVINGTNPGRTSDDQITLFDGTGVGLQDLAVAASVVEVAVEKGIAIEVDF

SEQ ID NO: 296 - protein, 330 aa, Colwellia sp MT41
MSDSQINKGVSVISEEVCQQVMGRANAFTAVENVFSAMAKKTAYNFPVIREAIGHADALYGFKSGFDRDGMVLGLKSGGYWPSNMAKGLTNHQSTVILFDPDTGKLKSLVGGNYLTAVRTAASSAISIAYLARKDAKVLGMIGAGHQSTFQLRAAVEQRNFEKVVCWNLHPEHISNLAAVAEELGLPFESVTREELCAQADVIITITSAFEALIEKDWIKPGTHIACMGTDTKGKQEVDAKLLTVAKVFTDELAQSITIGEAQHAIARKLIQQSDIVPIGEVINGTKPGRTSAEDITLFDGTGVGLQDLAVASLAAELAEAKGLATYFKL

SEQ ID NO: 297 - protein, 321 aa, Artificial Sequence
  synthetic peptide
  MISC_FEATURE (1)..(321): cNanh_4411
MIIVPEREIANLMTREAAFVAVEQVFAAMAAQDAYNFPVIREAIGHEDALYGFKGGFDRAGKTLGLKAGGYWPNNLDKHQIINHQSTVFLFDPDTGKAKAMVGGNLLTALRTAAASSVSIKHLARKDARVIGMIGAGHQATFQLRAALEQRQFEKVIGWNFHPEMLPNLEKVADEAGLPFQAVDLNGLRDADVLISITSSFEAILQADQVSPGTHIACMGTDTKGKQEVDPALLTRATVFSDEVAQSISIGEAQHAIAMELITEHDITQIGAVINGTHPGRTSDDQITLFDGTGVGLQDLAVAASVVDLAVANGVAIEVDF

SEQ ID NO: 298 - protein, 321 aa, Methylobacterium mesophilicum SR1.6/6
MIIVPEHAIDGLLTEAECFGAVEQVFASMARRRAGNFPVVREAIGHADALYGFKSGFDRDSLALGLKAGGFWPGNAAKGLTNHQSTVFLFDADTGRCKAVVGGNLLTALRTAAACAISVRHLAREDARVLGMIGAGHQSAFQLRAALAQRPFDRVLAWNLHPGMFGRMEAVAREHGVPFEAVELDRLGAEADVIVTITSSFAAILKAAQVRPGTHVACMGTDTRGKQEVEAELLAAATVFTDEVAQSVSIGEAQHAVARGLLAADSIVEIGAVINGDHPGRISESEITVFDGTGVGLQDLAVAAVAVDRAVAKGLATEVDF

SEQ ID NO: 299 - protein, 321 aa, Methylobacterium sp. B34; identical to SEQ ID NO: 272

SEQ ID NO: 300 - protein, 321 aa, Roseivivax halodurans JCM 10272
MIIVPEKDIADLMTREAAFAAVEQVFAAMASGDAYNFPVVREAIGHADALYGFKGGFDRLGGVLGLKAGGYWPHNLETHGIINHQSTVFLFDPDTGRVAAMVGGNLLTALRTAAASSVSIRHLAREDAEVLGMIGAGHQAAFQLRAALEHRSFGKVVGWNYHPEMLPNLEKVAAEAGVAFEAVDLPGMREADVIVTITSSFDATLMAEHVAPGTHVACMGTDTKGKQEVDPALLAAATVFADEIAQSVSIGEAQHAVSAGLISESDIAELGAVINGSHPGRRSDEEITLFDGTGVGLQDLAVAAAVVALARANDTAIEVEV

SEQ ID NO: 301 - protein, 338 aa, Pelagicola litoralis DSM 18290
MAAGIGCAAVAYFKELLMIIVPEHEISGLMTRQDSFDAVEKVFASMASGAAYNFPVIREAIGHADALYGFKSGFDRAGLNLGLKSGGYWPGNADKGLTNHQSTVFLFDADTGKCRAIVGGNLLTALRTAAASAVSIKYLAPKSAKVLGMIGAGHQSSFQLRAALDQRAFEKVIGWNLHPEHLSRLEDVATEAGLPFEAVELDQLGQEADTIITITSSFAPILKNAHVTGGTHIACMGTDTVGKQEVDAELVARAQVFTDEVAQSISLGECQHAMSAGLIRQEQIAQIGDVINGTHTGRTSENDITLFDGTGVGLQDLAVASAVVELAVARGVAIEVDF

SEQ ID NO: 302 - protein, 331 aa, Thalassobacter stenotrophicus DSM 16310
MDGSPMKSHEIIIVPEAEIAGLMTPEAAFDAVEAIFGAMARKDAYNFPVIREAIGHADALYGFKSGFDRAGGALGLKSGGYWPGNEAKGLTNHQSTVILFDRDTGRPKAMVGGNLLTALRTAAASAVSIKHLARADSKVLGMIGAGHQSAFQMRAALAQRPFEKVIGWNYHPEMLSRLEAVATEAGLPFEAVDLDRLGAEADVIISITSSFDAILHDAQVTAGTHVACMGTDTKGKQEVEAALVARATVFTDEIAQSTTIGEAQHAIASGLITEAAITEIGAVINGTHPGRTSAEEVTLFDGTGVGLQDLAVAEAVVDLALKTGVATRVPF

SEQ ID NO: 303 - protein, 321 aa, Methylobacterium sp. UNC300MFChir4.1
MIIVPEHAIDGLLTEAECFTAVEQVFASMARRRAGNFPVVREAIGHADALYGFKSGFDRDSLALGLKAGGFWPGNAAKGLTNHQSTVFLFDADTGRCRAVVGGNLLTALRTAAACAISVRHLARKDARVLGMIGAGHQSAFQLRAALAQRPFERVLAWNLHPGMFGRMEAVARERGVPFEAVDLDRLGAEADVVVTITSSFAPILKAAQVRPGTHVACMGTDTRGKQEVEAALLAAATVFTDEVAQSVSIGEAQHAVARGLLAADSIVEIGAVINGDHPGRVSESEITLFDGTGVGLQDLAVAAVAVDRAVAKGLATEVDV

SEQ ID NO: 304 - protein, 320 aa, Paracoccus pantotrophus DSM 1403
MLVVAEKEIAGLMTPEAAFEAIEAIFASMARRKAYNFPVVREAIGHEDALYGFKGGFDASALVLGLKAGGYWPNNQKHNLINHQSTVFLFDPDTGRATAAVGGNLLTALRTAAASAVSIKYLAPKGAKVLGMIGAGHQSAFQMRAVANVHPFEKVIGWNPHPEMLSRLADTAAELGLPFEAVELDRLGTEADVIISITSSFSPLLMDQHVKGPTHIAAMGTDTKGKQELDPALVARARIFTDEVAQSVSIGECQHAIASGLIREDQIGELGAVVAGDHPGRGDAEVTLFDGTGVGLQDLAVAQKVLEIAKEKGLAQEVEI

SEQ ID NO: 305 - protein, 321 aa, Rhizobium lusitanum P1-7; identical to SEQ ID NO: 160

SEQ ID NO: 306 - protein, 333 aa, Paracoccus alkenifer DSM 11593
MIIVPEHAIAGLVSASDCLEAVEQVFAAMARRSARNFPVIREALGHADALYGFKSGFDRESLALGLKSGGFWPGNISRGLTNHQSTVFLFDADTGACRAVVGGNLLTALRTAAASAISIKHLARPDARVLGMIGAGHQSSFQLRAALAQRHFEKVVGWNLHQPDLARLNAVATELGVPFEAVDLDRLGAEADVIITITSSFDPILMAAQVRPGTHLACMGTDTAGKQEVEPALVAAATVFTDEITQSITLGEAQHAAAQGLLAAAQITELGAVINGTHPGRTSAQEITLFDGTGVGLQDLAVASVAVDRALDKGVAITVDFQSPIGPAGATSP

SEQ ID NO: 307 - protein, 321 aa, Loktanella koreensis DSM 17925
MIIVPEKEIAGLMTREAAFDAVEAVFAAMSKGSAYNFPVIREAIGHADALYGFKSGFDRESLALGLKSGGFWPGNDAKGLTNHQSTIFLFDADTGQCRALVGGNLLTALRTAAASSVSIKHLARADAKVLGMIGAGHQSTFQMRAALEQRDFEKVIGWNYHPDMLSRLSDLADELGIPFEAVDLERMGQEADVIISITSAFAPSLMDAHISHGTHIACMGTDTKGKQEVETALLGRAKVFTDEIAQSVSIGEAQHAIAAGLLTADQITEIGSVINGDSPGRTSADDITLFDGTGVGLQDLAVASTVVDLAVAQGVAIEIEF

SEQ ID NO: 308 - protein, 321 aa, Methylobacterium sp. 190MF
MIIVSEREIATLVSPADCFAAVEGVFASMAKGKAYNFPVVREAIGHADALYGFKSGFDRESLALGLKSGGFWPGNVEKGLTNHQSTIFLFDADTGCCRAIVGGNLLTALRTAASSALSIKYLARPEARVIGMIGAGHQSTFQLSAALDQRRFEKVVGWNIEPSALGRLESVAVERGIPFEAVDLDRLGAEADVIITITSSFAPILKAAQVRPGTHLACMGTDTKGKQEVEAELLAKASVFTDEIAQATSIGEAQHAVAQGLLAATDIVAIGSVINGAHPGRRSPEDITLFDGTGVGLQDLAVASTAVDLAIARGVAREIDF

SEQ ID NO: 309 - protein, 321 aa, Methylobacterium sp. 190MF; identical to SEQ ID NO: 272

SEQ ID NO: 310 - protein, 332 aa, Ruegeria sp. ANG-S4
MRDEMNTQTDGLLIVDEDACEQLVGRQQAFDAVQDVFAAMARGDARNFPVVREALGHADAIYGFKSGFDRSGQVLGVKSGGYWPGNSQKGLTNHQSTVVLFDPDTGRITALVGGNYMTAVRTAASSAISIAHLARPDAQILGMVGAGHQSTFQLRAAAEQREFEKVVAWNPHPEMLPRLAEVAEDLGLEFEATTPEGLGAQADVIITITSAFEPLLKKDWVKPGTHLACMGTDTKGKMEVDPALVAAATLFTDEVAQSISIGEAQHAALKGEISQDAITPIGAVINGDHIGRSNDAEITLFDGTGVGLQDLAVASVAAQLAKNTGLANKVTL

SEQ ID NO: 311 - protein, 321 aa, Leisingera nanhaiensis CGMCC 1.10959; identical to SEQ ID NO: 297

SEQ ID NO: 312 - protein, 331 aa, Loktanella rosea DSM 29591
MSGRKRKTKTMIIVPEKEIAGLLTRADAFEAVEKVFASMSKGSAYNFPVIREAIGYEDALYGFKGGFDKAGMALGLKAGGYWPNNLEKHGEINHQSTVFLFDPDTGKVKAMVGGNLLTALRTAAASSVSIKHLARKDAKVMGMVGAGHQATFQLRAALEQRDFEKVIGWNYHPEMLPNIERVANEAGLPFEAVPLEGLAEADVVISITSTFAPTIMADHIAPGTHIACMGTDTKGKQEVEASLLARATVFTDEVAQSISIGEAQHAIASGLIEQSDVHELGAVINGTHPGRTSADEITLFDGTGVGLQDLAVASSIVDLAVEKGVATIVDF

SEQ ID NO: 313 - protein, 321 aa, Poseidonocella pacifica DSM 29316
MIIVPENKIGDLMTRADSFAAVEKVFASMAKGSAYNFPVIREAIGHADALYGFKSGFDRSELVLGLKSGGFWPGNMEKGLTNHQSTVFLFDADTGKCKAVVGGNLLTALRTAAASAVSIKYLAPKGAKVLGMIGAGHQSAFQMRAAAEQRDFEKVIGWNVDPAMLSRLEETAAEIGLPFEAVDLDRLGAEADTIITITSSFDAILMDAQVTGGTHIACMGTDTKGKQEVDAALVGRATVFTDEVAQSISIGEAQHAVANGVLKEADIAQIGAVINGDHPGRTSDDELTLFDGTGVGLQDLAVADAVVKRAVEAGVAVEVDF

SEQ ID NO: 314 - protein, 321 aa, Leisingera sp. ANG-S5
MYIVPEKAIADLVTREASFDAVEKVFAAMAAGDAYNFPVVREAIGHEDALYGFKGGFDRAGLTLGLKAGGYWPNNLEKRGLINHQSTVFLFDPDTGKVKAMVGGNLLTALRTAAASSVSIKHLARQDAKVIGMIGAGHQATFQLRAALEQRQFEKVIGWNYHPEMLPNIEKVAAEAGLPFEAVDLPGMTEADVIISITSAFAPSLMADHVSPGTHIACMGTDTKGKQEVEAELLVKASVFTDEVAQSISIGEAQHAVAQGLIQESDVAQIGAVINGTNPGRTSDDQITLFDGTGVGLQDLAVAASVVEVAVEKGIAIEVDF

SEQ ID NO: 315 - protein, 321 aa, Cribrihabitans marinus DSM 29340
MLIVPEREIADLMTREAAFDAVEKVFAAMASGDAYNFPVVREAIGHEDALYGFKGGFDRAGLTLGLKAGGYWPNNLDKRGIINHQSTVFLFDPDTGMVKAMVGGNLLTALRTAAASSVSIRHLARKDARVIGMIGAGHQARFQLRAALEQRDFEKVIGWNFHPEMLPNLQEVAEAAGLPFEAVELDGMREADVIVSITSSFDAILGADQVSPGTHVACMGTDTKGKKEVDPQLLVRADVFTDEVAQSVSIGEAQHAVGRGLISEADVAQLGAVINGSHAGRSSDDQITLFDGTGVGLQDLAVAAAVVDLAVERGIAIEVDF

SEQ ID NO: 316 - protein, 321 aa, Ruegeria mobilis DSM 23403
MYIVPERAIADLMTRDAAFDAVEKVFAAMAAGDAYNFPVVREAIGHEDALYGFKGGFDRAGLSLGLKAGGYWPNNLEKRGLINHQSTVFLFDPDTGKVRAMVGGNLLTALRTAAASSVSIKHLAREDAKVIGMIGAGHQAKFQLRAALEQRDFDKVIGWNLHPEMLLNLEEVATEAGLPFEAVELDGMRAADVIISITSSFDAILKADQVSPGTHIACMGTDTKGKQEVDPQLLVRATVFTDEVAQSTSIGEAQHAVAQGLIGEADVAQLGAVINGAHPGRTSAEQITLFDGTGVGLQDLAVAASVVELAVKKGIAIEVDF

SEQ ID NO: 317 - protein, 321 aa, Pseudopelagicola gijangensis DSM 100564
MWIVPEREIAGLMTREAAFGAVEKVFSSMASGDAHNFPVIREAIGHEEALYGFKGGFDRAGAALGLKAGGYWPHNLEKRGLINHQSTVFLFDPDTGKASAMVGGNLLTALRTAAASSVSIKHLARSDAKVIGMVGAGHQATFQLRAALEQRNFDKVIGWNLHPEMLPNLEKVATQAGLPFEAVELDGLHEADVIITITSSFEASLMSHHVSDGTHIACMGTDTVGKQEVEPALIERASVFTDEVAQAISLGESQHAVCAGTKAESDINEIGAVINGTHRGRKSDDEVTLFDGTGVGLQDLAVAASVVDLAIAKGVAIEVDF

SEQ ID NO: 318 - protein, 327 aa, Ruegeria atlantica CECT 4293
MTTQDGLLIVGEDLCEQLVGRQQAFDAVQSVFGAMANGGARNFPVVREALGYADALYGFKSGFDRDGQVLGVKSGGYWPGNAEQGLTNHQSTVFLFDPDTGRLSALVGGNYLTAVRTAASSAVSIAQLARKDAKVLGMVGAGHQSAFQLRAAAEQRDFEKVVAWNPHPDMLPRLAAVAEEIGLEFEAVSQQELGAQSDVIITITSAFEPLLMKDWIKPGTHLACMGTDTKGKMEVDPALVASATVFTDEVAQSATIGEAQHAMGSGTLTETQITPIGAVINGDHPGRSSADEITLFDGTGVGLQDLAVASVAARLADEAGLAQRATL

SEQ ID NO: 319 - protein, 331 aa, Thalassobacter stenotrophicus CECT 5294; identical to SEQ ID NO: 302

SEQ ID NO: 320 - protein, 321 aa, Loktanella sediminilitoris DSM 29955
MLIVPEREIADLMTRDAAFDAVEKVFAAMAAGDAYNFPVVREAIGHEDALYGFKGGFDQAGLTLGLKAGGYWPHNLEKRGIINHQSTVFLFDPDTGKAKAMVGGNLLTALRTAAASSVSIKHLARDDASVIGMIGAGHQATFQLRAALEQRQFEKVIGWNYHPDMLPNIEKVATEAGLPFEAVELEGMVDADVIISITSAFAPSLMADHVSPGTHIACMGTDTKGKQEVEAALLARAAVFTDEVAQSISIGEAQHAIGAGLIAETDINQLGAVINGTHAGRTSDDQITLFDGTGVGLQDLAVAAAVVDLAVQKGIAIEVDF

SEQ ID NO: 321 - protein, 321 aa, Rhizobium taibaishanense DSM 100021T
MLIVPEREIANLITAADCFTAVERVFASMANKAAYNFPVIREAIGHADALYGFKSGFDRESLALGLKAGGFWPNNVSKGLTNHQSTIFLFDADTGKCRAAVGGNLITALRTAAASAVSIKYLARQEAKVLGMIGAGHQSAFQLRAALQQRQFEKVVAWNFHPEMLSRLEQVANDEGLPFEVLDLERLGAESDVIISITSSFAPLLKASQVRPGTHVACMGTDTKGKQEVEPELVAMATVFTDEIAQAVTIGECQHAVERGITNKEAIIEIGAVISGKHPGRSSADEITLFDGTGIALQDLAVASVAVELALVKGVAIEIDF

SEQ ID NO: 322 - protein, 321 aa, Rhodobacteraceae bacterium JGI 01_L11_4000m
  MISC_FEATURE: Contamination screened
MLIVPEREIADLMTRAAAFDAIEKVFAAMASGDAYNFPVVREAIGHEDALYGFKGGFDRAGLTLGLKAGGYWPNNLEKRGLINHQSTVFLFDPDSGKVKAMVGGNLLTALRTAAASSVSIKHLARKDASVLGMVGAGHQATFQLRAALEQRNFEKVIGWNYHPEMLPNIEKVAQEAGVPFEAVDLPAMTEADVIISITSAFAPSLMADHVSPGTHVACMGTDTKGKQEVEAALLGRAAVFTDEVAQSVSIGEAQHAIAEGIITETDVAQLGAVINGDHPGRISKDQITLFDGTGVGLQDLAVAAKVVDLAVEKGIAVEVDF

SEQ ID NO: 323 - protein, 321 aa, Sulfitobacter sp. HI0054; identical to SEQ ID NO: 322

SEQ ID NO: 324 - protein, 321 aa, Labrenzia aggregata CECT 4801
MIIVPEKEIAGLIGRQESFDAVESVFAAMAGGAAYNFPVIREAIGHADALYGFKSGFDRSSLALGLKSGGYWPGNMAKGLTNHQSTVFLFDADTGKAKAVVGGNLLTALRTAAASAVSIKHLARKDAKVLGMIGAGHQSAFQMRAAVEQRDFEKVLGWNLHPEMLVRLEETANELGLPYESVDLARLGAEADVIISITSSFDPILMEEHVSPGTHIACMGTDTKGKQEVDVALVAKAKLFTDEIAQSATIGECQHAVASGIVSEDNIIEIGAVINGNHPGRTSQSDITLFDGTGVGLQDLAVASAAVDLAIQKGVAIEVDF

SEQ ID NO: 325 - protein, 321 aa, Roseovarius nubinhibens ISM
MLIVPERQIPDLLTRSASFTAVEKVFAAMAAGQAYNFPVIREAIGHEDALYGFKGGFDRDGHTLGLKAGGYWPHNLEKRGLINHQSTVFLFDPDSGMISAMVGGNYMTALRTAAASAVSIQHLARPDAKVIGMIGAGHQATFQLRAALEQRPFEKVIGWNLHPEMLPNLAAVAEEAGLPFEAVELDGMTEADVIITITSSFAPSLLAQHVSPGTHIACMGTDTKGKQELEAALLGSATVFADEIDQSITLGEAQHAIATGLISRDDITEIGAVINGTHPGRSSAEEITLFDGTGVGLQDLAVAAAVVDLAVEQGVAIEVDF

SEQ ID NO: 326 - protein, 321 aa, Roseobacter sp. SK209-2-6
MYIVPEREIAGLMTREASFAAVEKVFAAMAAKDAYNFPVIREAIGHEDALYGFKGGFDRAGQTLGLKAGGYWPNNLEKRGLINHQSTVFLFDPDTGKASAMVGGNLLTALRTAAASSVSISHLARKDAKVIGMIGAGHQAKFQLRAALEQREFEKVIGWNLHPEMLPNLQEVADEAGLPFEAVELDGMREADVIISITSSFDAILGADQVSPGTHLACMGTDTKGKQEVDPALLVKATVFTDEVAQSISIGEAQHAIAQGLIGEGDIAQLGAVINKAHPGRQSDEEVTLFDGTGVGLQDLAVASAVVDQAVKTGIAIEVDF

SEQ ID NO: 327 - protein, 321 aa, Rhodobacterales bacterium HTCC2083
  MISC_FEATURE: scf_1106200183017 genomic scaffold
MWIVPEREIADLLTRDASFEAVENVFAAMAAGDAYNFPVIREAIGHEDALYGFKGGFDGVGGTLGLKAGGYWPHNLEKRGLINHQSTVFLFDPDTGKVAAMVGGNYLTALRTAAASSVSIKHLARADAKVMGMVGAGHQATFQLRAALEQRAFEKVIGWNYHPEMLPNIEKVANEAGVPFEAVELDGLGEADVVISITSTFAPTIMAEHISAGTHIACMGTDTKGKQEVEAALLARASVFTDEVAQSVSIGEAQHAIAERLIAVSDVTQIGAVINGTHEGRTSEEEITLFDGTGVGLQDLAVSAAIVRMAIEQGVAIEVDF

SEQ ID NO: 328 - protein, 321 aa, Agrobacterium sp. ATCC 31749 AGT22
MIIVPEHEIESLVSASDCFTAVERVFASMAQKSAYNFPVIREAIGHADALYGFKSGFDRESLALGLKSGGFWPNNIEKGLTNHQSTIFLFDADTGKCRAVVGGNLLTALRTAAASAVSIKYLARPDAKVLGMVGAGHQSTFQLRAALEQRAFEKVVGWNIYPEALDRLAKIAAEHDVPFEAVDLDRLGAEADVIITITSAFAPILKAAQIRRGTHLACMGTDTKGKQEVEAELLAAATIFSDEIAQSVTIGEAQHPVARGLISPDRITEIGAVINGAHPGRTNADEITVFDGTGVGLQDLAVASKAVDLAVQKGVAVVVDF

SEQ ID NO: 329 - protein, 320 aa, Paracoccus sp. TRP
  MISC_FEATURE (1)..(320): Paracoccus_TRP_Contig_10
MYVVAEKEIAGLMNPEAAFEAIEAVFAAMARRKAYNFPVVREAIGYEDALYGFKGGFDASGLALGLKAGGYWPNNQKHGLINHQSTVFLFDPDTGRVSAAVGGNLLTALRTAAASAVSIKYLAPIGAKVLGMIGAGHQSAFQMRAAANVHGFEKVIGWNPHPEMLSRLADTAAELGLPFEAVDLPQLGEEADVIISITSSFSPLLLNEHVKGPTHIAAMGTDTKGKQELDPALVTRARIFTDEVAQSISIGECQHAIAAGLIKEEQISELGAVVTGDNPGRADAEVTLFDGTGVGLQDLAVAQKVLEIAKEKGIAQQVEI

SEQ ID NO: 330 - protein, 321 aa, Artificial Sequence
  synthetic peptide
  MISC_FEATURE (1)..(321): pAqui_F126
MYIVPEKAIADLVTREASFDAVEKVFAAMAAGDAYNFPVVREAIGHEDALYGFKGGFDRAGLTLGLKAGGYWPNNLEKRGLINHQSTVFLFDPDTGKVKAMVGGNLLTALRTAAASSVSIKHLARQDAKVIGMIGAGHQAKFQLRAALEQRSFEKVIGWNLHPEMLPNLQEVADEAGLPFEAVELDGMREADVIISITSSFDAILKADQVSPGTHVACMGTDTKGKQEVDPQLLVAADVFTDEVAQSVSIGEAQHAIAQGLIQKGDVAQIGAVINGINPGRTSDDQITLFDGTGVGLQDLAVAASVVDVAVEKGIAIEVDF

SEQ ID NO: 331 - protein, 274 aa, Ruegeria mobilis F1926
DALYGFKGGFDSAGLSLGLKAGGYWPNNLEKRGLINHQSTVFLFDPDTGKVRAMVGGNLLTALRTAAASSVSIKHLAREDAKVIGMIGAGHQAKFQLRAALEQRDFDKVIGWNLHPEMLPNLKEVATEAGLPFEAVELDGLKEADVIISITSSFDAILKADQVSPGTHIACMGTDTKGKQEVDPQLLVRATVFTDEVAQSISIGEAQHAVAQGLITEADVAQLGAVINGAHPGRSSAEQITLFDGTGVGLQDLAVAASVVELAVKKGVAIEVDF

SEQ ID NO: 332 - protein, 321 aa, Oceanicola sp. HL-35
MLIVPEREIADLMTREAAFEAVEKVFAAMAAGDAYNFPVVREAIGHEDALYGFKGGFDRAGLTLGLKAGGYWPNNLDKRSIINHQSTVFLFDPDTGKARAMVGGNLLTALRTAAASSVSIRHLARKDAKVIGMIGAGHQAKFQLRAALEQRGFEKVIGWNLHPEMLPNLEEVASEAGLPFEAVELDGMTEADVIITITSSFGAILSAGQVSPGTHVACMGTDTTGKQEVEPALLGHATVFTDEVAQSVSIGEAQHAVSQGLIAESDIAQLGAVINGSHPGRISDHQITLFDGTGVGLQDLAVAAAVVDLAVEKGIAIEVDF

SEQ ID NO: 333 - protein, 333 aa, Psychrobacter sp. G
MSEANSVNSDEGLLIVSEDACKSVIDRPSAFIAVENVFASMSRGDAYNFPVIREAIGYADALYGFKSGFDRAGKSLGLKSGGYWPGNAAKGLTNHQSTIFLFNPDNGKLRALVGGNYLTAVRTAAASAVSIAHLARKDSKVLGMVGAGHQSTFQLRAALEQRNFEKVVAWNKNKDRLKNLQAVAEELGVPFEAVEREQLCSEADVIITITSAFEPLLMKEWIKPGTHIACMGTDTVGKQEVDVNLVAAATVFTDEIAQSISLGEAQHAIKSGAIKESDITTLGDVINGDHPGRSSDDEITLFDGTGVGLQDLAVASAAAKLALEKGEAQHISL

SEQ ID NO: 334 - protein, 321 aa, Ensifer meliloti Rm41
MIIVPENQIAGLITPADCLVAVEGVFASMAKRSAYNFPVIREAIGHADALYGFKSGFDRDSLALGLKSGGFWPNNVQKGLANHQSTVFLFDADTGRCRAMVGGNLLTALRTAAASAVSIKYLARKDAKVLGMIGAGHQSTYQLRAAVEQRPFEKVLAWNLHPEMLSRLEGVARELELPFETVDLDRLGDESDVIISITSSFAPILKASQVRPGTHLACMGTDTKGKQEMDAELIAAATVFADEVAQAITIGECQHAIEKGLISRDDIVEIGAVITGRHPGRSSPEEITLFDGTGVGLQDLAVASAAVELALSNGTAIEVDF

SEQ ID NO: 335 - protein, 334 aa, Roseovarius sp. MCTG156(2b)
MMNTHVETTADGFVIVGEEICQKIISRADAFGAVEAVFAAMARGDAYNFPVVREAIGHADALYGFKGGFDRSGLSLGLKAGGYWPGNMDKGLTNHQSTVFLFDPDTGRLSALVGGNYLTALRTAASSSVSIAHLAREDSKVLGMVGAGHQSAFQLRAAVEQRSFEKVVAWNPHPDMLPRLGAVAEELGLEFEAVTQEELGAQADVIITITSAFEPLMMADWVKPGTHIACMGTDTKGKQEVDPALFTRATVFADEIAQSVSIGEAQHAVAQGLISEGDITPIGAVINGTHAGRASAEEVTLFDGTGVGLQDLAVASVAAKLARDQGLVTPITLG

SEQ ID NO: 336 - protein, 321 aa, Rhizobium rhizogenes OK036
MIIVPETEIAGLVTAADCFKAVEGVFASMANKSAYNFPVVREAIGHADALYGFKSGFDRKGLALGLKAGGFWPNNVHRGLTNHQSTVFLFDPDTGKCRAVVGGNLLTALRTAAASAISIKYLARKDAKVLGMIGAGHQATFQLRAALAQRQFEKIVGWNLHPDMLSRLEEVAKEEGLPFEAVDLDRLGAEADVIISITSSFAPMLKASQVRAGTHLACMGTDTKGKQEIEAEILVKATVFTDEVAQAVTIGESQHAIERGLIREEAIVEIGAVINGTHPGRISADQITLFDGTGVGLQDLAVASAAVELALAKGVAIEVDF

SEQ ID NO: 337 - protein, 321 aa, Rhizobium leguminosarum YR374; identical to SEQ ID NO: 230

SEQ ID NO: 338 - protein, 321 aa, Methylobacterium sp. YR668; identical to SEQ ID NO: 244

SEQ ID NO: 339 - protein, 321 aa, Sinorhizobium americanum CCGM7
MIIVPENQIAGLITPADCLVAVERVFASMAEKSAYNFPVIREAIGHADALYGFKSGFDRDSLALGLKSGGFWPHNVEKGLANHQSTVFLFDADTGRCRAMVGGNLLTALRTAAASAVSIKYLARKDAKVLGMIGAGHQSTYQLRAAVEQRPIEKVLAWNLHPEMLSRLEEVARELELPFETVDLDRLGAEADVIISITSSFAPILKASQIRPGTHLACMGTDTKGKQEVDPELVAAATVFTDEVAQAVTIGECQHAIDKGLISKDDIVEIGAVITGRHKGRSSSEEITLFDGTGVGLQDLAVASAAVELALSKGAAIEVDF

SEQ ID NO: 340 - protein, 321 aa, Palleronia marisminoris DSM 26347
MLIVPEREIANLMTREAAFDAVEKVFAAMASDDARNFPVVREAIGHEDALYGFKGGFDRAGLTLGLKAGGYWPHNLEKHELINHQSTVFLFDPDTGRAKAMVGGNLLTALRTAAASSVSIKHLAREDAKVIGMIGAGHQATFQLRAALEQRRFEKVIGWNYHPEMLPNIEKVATEAGLPFEAVDLPGMAEADVIITITSAFAPSLMADHVSPGTHIACMGTDTKGKQEVETALLGRATVFTDEVAQSISIGEAQHAIQDLSLRPEDIIQLGRVINGSHEGRTSDDEITLFDGTGVGLQDLAVAAAVVDLAVEKGISIEVDF

SEQ ID NO: 341 - protein, 320 aa, Paracoccus aminovorans DSM 8537
MFVVAEKEIAGLMTPEAAFEAIEAIFASMARRKAYNFPVVREAIGHEDALYGFKGGFDASALTLGLKAGGYWPNNQKHNLINHQSTVFLFDPDTGRVSAAIGGNLLTALRTAAASAVSIKYLAPQGAKVLGMIGAGHQSAFQMRAAAAVHQFEKVIGWNPHPEMLGRLAETAADLGLPFEAVELDRLGAEADVIISITSSFSPLLMNEHVKGPTHIAAMGTDTKGKQELDPALVARARVFTDEVAQSVSIGECQHAIAAGLIAEDQIGELGAVVAGDDPGRGDAEVTIFDGTGVGLQDLAVAAKVLEIAKEKGVAQTVEI

SEQ ID NO: 342 - protein, 321 aa, Yangia pacifica CGMCC 1.3455; identical to SEQ ID NO: 280

SEQ ID NO: 343 - protein, 321 aa, Roseovarius indicus DSM 26383
MIIVPEREIADLMTREAAFEAVERVFAAMAAGEAYNFPVVREAIGHEDALYGFKGGFDRSGLTLGLKAGGYWPHNLAKRGVINHQSTVVLFDADTGRVHAMVGGNLLTALRTAAASAVSIRYLAREDARVLGMIGAGHQAAFQLRAALEQRRFEKVIGWNLNPEMLPNLEKVAEEAGVPFEAVELGGMREADVIISITSSFEAILGADQVSPGTHVACMGTDTKGKQEVAPGLLARAVVFTDEVAQSVSIGEAQHAVAMGLIGEGDVQQLGAVINGAHPGRRSAEEITLFDGTGVGLQDLAVASRVVELAQEAGRAVMVDF

SEQ ID NO: 344 - protein, 321 aa, Jannaschia rubra DSM 16279; identical to SEQ ID NO: 134

SEQ ID NO: 345 - protein, 321 aa, Rhizobium etli bv. phaseoli IE4803
MIIVPERAIADLIGSAECFTAVEQVFAAMARKSAYNFPVVRESIGYADALYGFKSGFDRESLSLGLKSGGFWPKNVEKGLTNHQSTVFLFDADTGRCRAVVGGNLLTALRTAAASAISIKYLAREDAKTLGIIGAGHQSTFQLRAAVEQRNFEKVVAWNYHPEMLNRLAEVAREIGLPFEAVDLDRLGAEADVIISITSSFSPSLMAAQVRPGTHLACMGTDTKGKQEVDAKLVAASSIFTDEVAQAITIGECQHAIADGLIGEADILEIGAVITGDVKGRRSADDITLFDGTGVGLQDLAVAAAVVDLAVREGVAIEVDF

SEQ ID NO: 346 - protein, 321 aa, Roseivivax sediminis DSM 26472
MLIVPEREIADLMTREAAFAAVEKVFAAMASGDAYNFPVVREAIGHEDALYGFKGGFDRAGLTLGLKAGGYWPNNLDKRGIINHQSTVFLFDPDTGKAKAMVGGNLLTALRTAAASSVSIRHLARKDAKVIGMIGAGHQAKFQLRAALEQRDFDKVIGWNLHPDMLPNLEEVAAEAGLPFEAVELDGMQEADVMISITSSFDAILSAGQVAPGTHIACMGTDTKGKQEVDPQLLAKATVFTDEVAQSVSIGEAQHAVAQGLIAEGDIAQLGAVINGSHKGRASDEEITLFDGTGVGLQDLAVANAVVELAVEKGIAIEVDF

SEQ ID NO: 347 - protein, 321 aa, Agrobacterium sp. KFB 330
MIIVPEHEIEGLVSASDCFTAVERVFASMAQKSAYNFSVIREAIGHADALYGFKSGFDRESLALGLKSGGFWPNNMEKGLTNHQSTIFLFDADTGKCRAVVGGNLLTALRTAAASAVSIKYLARPDAKVLGMVGAGHQSSFQLRAALQQRPFEKVIGWNLFPEALDRLAKVAAEHDVPFEAVDLDRLGAEADVIITITSSFAPILKAAQIRPGTHLACMGTDTKGKQEVEAELLAAATIFSDEIAQSVTIGEAQHPVAKGLISPNRIIEIGAVINGAHPGRSNADEITVFDGTGVGLQDLAVASKAVDLAVQKGVAVVVDF

SEQ ID NO: 348 - protein, 321 aa, Leisingera sp. ANG-DT; identical to SEQ ID NO: 314

SEQ ID NO: 349 - protein, 321 aa, Methylobacterium sp. ME121
MIIVPEHAIDGLLTEAECFGAVEQVFASMARRRAGNFPVVREAIGHADAIYGFKSGFDRDSLALGLKAGGFWPGNAAKGLTNHQSTVFLFDADTGRCRAVVGGNLLTALRTAAACAISIRHLAREGARVLGMIGAGHQSAFQLRAALAQRPFERVLAWNLHPGMFGRMEAVARERGVPFEVVDLDRLGAEADVVVTITSSFAPILKAAQVRPGTHVACMGTDTRGKQEVEAELLAAATVFTDEVAQSVSLGEAQHAVARGLLAADSIVEIGAVINGDHPGRVSDAEITVFDGTGVGLQDLAVAAVAVDRALAKGLATEVGF

SEQ ID NO: 350 - protein, 321 aa, Litoreibacter meonggei DSM 29466
MLIVPEREIADLMTREAAFDAVEGVFAAMASKDAYNFPVIREAIGHEDALYGFKGGFDKAGMTLGLKAGGYWPNNLEKHGHINHQSTIFLFDPDTGMVSAMVGGNLLTALRTAAASSVSIKHLARKDAKVMGMVGAGHQATFQLRAALEQRQFEKVIGWNYHPEMLPNIEKIANEAGLPFEAVELEGMREADVVISITSTFAPTIMADHIAPGTHIACMGTDTKGKQEVEAALLARATVFTDEVAQSVSIGEAQHAVAQGLIKESDVHQLGAVINGTDKGRASDDEITLFDGTGVGLQDLAVAASVVELAVQKGVAIDVDF

SEQ ID NO: 351 - protein, 321 aa, Litoreibacter halocynthiae DSM 29467
MLIVPEREIANLMTRDAAFDAVEGVFAAMASKDAYNFPVIREAIGHEDALYGFKGGFDKAGMTLGLKAGGYWPNNLEKHGHINHQSTIFLFDPDTGMVSAMVGGNLLTALRTAAASSVSIKHLARKDAKVMGMVGAGHQATFQLRAALEQRQFEKVIGWNYHPEMLPNIEKIANEAGLPFEAVELEGMREADVVISITSTFAPTIMADHIAPGTHIACMGTDTKGKQEVEAALLARATVFTDEVAQSISIGEAQHAVAEGLIKESDVHQLGAVINGTHKGRTSDDEITLFDGTGVGLQDLAVAASVVELAVQKGVAIEVDF

SEQ ID NO: 352 - protein, 329 aa, Roseivivax lentus DSM 29430
MSNEKDGSVVIVTEEICQKVVDRASAFTAVEQVFGAMAKGDAYNFPVIREAIGYADALYGFKSGFDRVGGSLGLKSGGYWPGNAEKGLTNHQSTVFLFDPDTGRLQALVGGNYLTAVRTAASSSVSIAHLARKDAKVLGMVGAGHQSAFQLRAAAEQRDFERVVAWNPHPDMLPKLGEVAKDLGLDFEAVSQEELGAQADVIITITSAFEPLLMADWIKPGTHIACMGTDTKGKQEVDAALLARATVFTDEIAQSISIGEAQHAVGQGLIAEGDITPIGAVINGDHKGRTSEDEITLFDGTGVGLQDLAVASVAAKLARERGMAQTVML

SEQ ID NO: 353 - protein, 321 aa, Rhodovulum sulfidophilum DSM 2351
MFIVPEKEIAGLVSADQCFEAVEAVFAAMARGDAYNFPVIREAIGHAEALYGFKSGFDRAGSVLGLKSGGYWPGNAAKGLTNHQSTVVLFDPDSGRPAALVGGNLLTALRTAAASAVSIRYLARSDARVLGVLGAGHQSAFQLRAAVAQRRFEKIVGWNYHPEMLPRLAETAAELGLPFEAVSLEDLGAQADVIVTISSSFSAQLMDAHVRPGTHLACMGTDTKGKQEIDPAIFARARVFADEIAQSVEIGEAQHAVAAGLIAAEDIVEIGAVINGTAPGRQSDDEITVFDGTGVGLQDLAVAARAVAAARARGLAVEVDL

SEQ ID NO: 354 - protein, 325 aa, Roseobacter denitrificans DSM 7001; identical to SEQ ID NO: 70

SEQ ID NO: 355 - protein, 321 aa, Leisingera sp. ANG-Vp
MYIVPEKEIAGLMTREAAFDAVEKVFASMASGDAYNFPVVREAIGHEDALYGFKGGFDRAGLTLGLKAGGYWPNNLEKRGLINHQSTVFLFDPDTGKAKAMVGGNLLTALRTAAASSVSIKHLARKDAKVIGMIGAGHQAKFQLRAALEQREFEKVIGWNLHPDMLPNLQEVADEAGLPFEAVELDGMREADVIISITSSFDAILNAGQVSPGTHIACMGTDTKGKQEVDPQLLVAADVFTDEVAQSITIGEAQHAVAQGLIQEADVAQIGAVINGTNPGRTSDDQITLFDGTGVGLQDLAVAASVVDLAVAQGIAIEVDF

SEQ ID NO: 356 - protein, 321 aa, Marivita hallyeonensis DSM 29431
MYIVPEAKIADLVSREASFEAVEQVFAAMASKDAYNFPVVREAIGHEDALYGFKGGFDRVGGSLGLKAGGYWPHNLEKRGLINHQSTVFLFDPDTGRVHAMVGGNLLTALRTAAASSVSIKHLAREDAKVMGMIGAGHQATFQLRAALEQRSFEKVIGWNYHPEMLPNIEKVAQEAGLPFEAVELEGMREADVIISITSAFSPSLMADHVSEGTHIACMGTDTKGKQEVEAALLAKAKVFTDEVAQSISIGEAQHAVGSGLIAESDVIEIGAVINGAHPGRTSDSDITLFDGTGVGLQDLAVASKVVELAIERGVAIEVDF

SEQ ID NO: 357 - protein, 321 aa, Labrenzia alba CECT 7551
MIIVPEKEIAGLIGRVEAFEAVENVFAAMSSGAAYNFPVIREAIGHADALYGFKSGFDRSSLALGLKSGGYWPGNADKGLTNHQSTVFLFDADTGQAKAVVGGNLLTALRTAAASAVSIKHLAREDAKVLGMIGAGHQSAFQMRSAVEQRKFEKVIGWNFHPEMLSRLEETATELGLPYESVDLDRMGTEADVIISITSSFDPILMADQVTQGTHIACMGTDTKGKQEVDTGLVARATLFTDEVAQSATIGECQHAVAAGIVSRDNINEIGAVINGTHSGRTSESEITLFDGTGVGLQDLAVASAAVELAVQKGVAIEVAF

SEQ ID NO: 358 - protein, 321 aa, Thalassobius abyssi DSM 100673
MWIVPEREIAGLVSREAAFDAVEQVFAAMAAGRANNFPVVREAIGHENALYGFKGGFDQLGGALGLKAGGYWPNNLEKRGLINHQSTVFLFDPDTGRPVAMVGGNLLTALRTAAASSVSIQHLSRPDARVIGMVGAGHQATFQLRAALEQRSFEKVIGWNRHPEMLPNIQKVAEDADLPFEAVELGDLSEADVIITITSSFGPILMVDHVAPGTHIACMGTDTKGKQEVEARLLANSLVFTDEVAQSISIGEAQHAVASGALASDAVIEIGRVINGDHPGRQSADEITLFDGTGVGLQDLAVAAKVVDLAIEKGVAIKVDI

SEQ ID NO: 359 - protein, 321 aa, Roseovarius indicus B108 cultivar; identical to SEQ ID NO: 343

SEQ ID NO: 360 - protein, 321 aa, Litoreibacter ponti DSM 100977
MYIVPESAIADLISAEASFDAVEAVFASMAKGDAYNFPVIREAIGHEEALYGFKGGFDGKGMALGLKAGGYWPHNLEKRGLINHQSTVFLFDPDTGRVASMVGGNLLTALRTAAASSVSIKHLARKDARVMGMIGAGHQAKFQLRSALQTHAFEKVISWNYHPEMLPGMAEVAAEFDLPFEEVQLEGMTEADVVISITSSFAPIFGPDHIAPGTHVACMGTDTIGKQECEAELLARATVFTDEVAQSISIGEAQHAVKAGLIMETEVNQIGDVINGVHKGRSSDDEITLFDGTGVGLQDLAVAQSVVEIAVERGVAIEVDF

SEQ ID NO: 361 - protein, 321 aa, Yangia sp. CCB-MM3
MLIVPEREIASLMTRDAAFAAVEKVFAAMAAGDAYNFPVVREAIGHEDALYGFKGGFDRSGLTLGLKAGGYWPNNLATRGIINHQSTVFLFDPDTGKAKAMVGGNLLTALRTAAASSVSIRHLAREDARVIGMVGAGHQATFQLRAALEQREFDKVIGWNLHPEMLPNLEKVAAEAGVPFEAVDLPGMREADVIISITSSFDAILMAEHVSPGCHIACMGTDTKGKQEVSPALLAKATVFTDEVAQSVSIGEAQHAVAQGLIDESAITQLGAVINGAHPGRASAEEITLFDGTGVGLQDLAVAAAVVDLAVEKGIAIEVDF

SEQ ID NO: 362 - protein, 321 aa, Granulosicoccus antarcticus IMCC3135
MFVVSEEVCRKVVSRADAFDAVQAVFAAMARGDARNFPVVREALGHADALYGFKSGFDRAGLALGVKSGGYWPGNAQKGLTNHQSTVFLFDPDTGQLQALVGGNYLTAIRTAAASAVSIAHLARKDARVLGMIGAGHQAQFQLRAAAEQRQFEKVIAWNLHPEKLSILEAVATELGLPFEAVGRQQLAEQADTIITITSAHEALLDSGWIRPGTHIACMGTDTAGKQELDPQLFSDASVFTDELAQSITIGEAQHAFKAGQLQEADITALGAVINGDHPGRVTDDEITVFDGTGVGLQDLAVAAVALRVACEEGDAKEIAL

SEQ ID NO: 363 - protein, 321 aa, Tateyamaria omphalii DOK1-4
MLIVPEKDIADLMTRDAAFDAVEQVFAAMASDDAYNFPVVREAIGHEDALYGFKGGFDRAGATLGLKAGGYWPHNLEKRDLINHQSTVFLFDPDTGKPAAMVGGNLLTALRTAAASSVSIKHLARPDAKVLGMIGAGHQATFQLRAALEQRAFDRVIGWNYHPDMLPNIAKVAEDAGLPFEAVDLPGMAEADVIISITSAFAPSLMADHVSPGTHIACMGTDTKGKQEVEAALLARATVFTDEVAQSISIGEAQHAIAAGLIAESDIHQIGAVINGAHPGRTSDTDITLFDGTGVGLQDLAVAARVVDLAQKKGIAIHVDF

SEQ ID NO: 364 - protein, 396 aa, Silicibacter pomeroyi DSS-3
  MISC_FEATURE (1)..(396): megaplasmid
MSFQNPVFIPGPTNIPESLRKACDMPTIDHRSPLFGQILHPARAGVRAVLKSETAEIFIFPSTGTGGWETALTNTLSAGDGVLAARNGMFSHRWIDMCQRHGLAVEVVETPWGEGLPADRYEEILAADTHHRIKAVLATHNETATGVRSDIAAVRRALDKAGHPALLFVDGVSSIGSMDFRFDEWRVDVAVTGSQKGFMLPAGLAIVGFSAKAMEATATGTLPRTFFDVHDMARGYANNAYPYTPAVGLMNGLNQACRMLLDEGLENVFARHHRIAEGVRAAVHAWGLELCAASPDLYSDTVSAIRTPEGFNATDIVTHAASKYGVAFGVGLGEVAGKVFRIGHLGSLTDVMTLSGIATAEMCMADLGLDIGLGSGVAAAQEYFRSHSATSLLAAA

SEQ ID NO: 365 - protein, 396 aa, Silicibacter sp. TM1040
MSFQNPVFIPGPTNIPESLRKACDMPTIDHRSPLFGQILHPAREGVRKVLKSDSAEVFIFPSSGTGGWETALSNTLSPGDTVLAARNGMFSHRWIDMCQRHGLEVEIIETPWGEGLPADRYEEILTADTSHKIKAVLATHNETATGVKSDIAALRRALDAAAHPALLFVDGVSSIASMDFRMDEWGVDVAVTGSQKGFMLSAGLAIVGFSAKAMDATQSARLPRTFFDVHDMAKGYANNAYPYTPAVGLMNGLNESCKMLLAEGLEDVFARHHRIAEGVRAAVGAWGLELCAATPEVYSDTVSAIRTPEGFNATDIVTHAAEKYGVAFGVGLGEVAGKVFRIGHLGSLTDVMALSGIATAEMCMVDLGLDIRLGSGVAAAQDYYRGHTAAAQKDAA

SEQ ID NO: 366 - protein, 396 aa, Loktanella vestfoldensis SKA53
MSFQNPVFIPGPTNMPESIRKACDMPTIDHRSPLFGQILHPARANVQKVLKSANADVFIFPSTGTGGWETAITNTLSAGDTVLAARNGMFSHRWIDMCQRHGLDVQIVETPWGHGLPADRYAEALAADKGHKIKAVLATHNETATGVKSDIAAVRAALDAADHPALLFVDGVSSIGSMNFEFDAWGVDIAVTGSQKGFMLPAGLAILGFSAKARAATKTAGLPRTFFDVNDMAKGYDNSAFPYTPPVGLMNGLLLASDMLLREGLDNVFARHTRIASGIRAAVHAWGLELCAATPDLYSDTVSAIKTPAGFNATEIVNHAASAYGVAFGTGLGEVAGKVFRIGHLGSMTDVMALSGIATAEMCMVDLGLDIKLGSGVAAAQDHYRRTTGQALQDAA

SEQ ID NO: 367 - protein, 393 aa, Marinomonas sp. MED121
MSEQNPVFIPGPTNIPNRLLNAMHIQTQDHRSPNFVETLTPVLEGCKKVFGTTTGEVITFPSTGTGGWEAAISNTLSAGDKVLIARYGMFSHRWIDLCQRHGLEVVVIECPWGDGAPADLFEEALNADNNHDIKAVLVTHNETATGVRSDIAGVRKAMNNVNHPAMLFVDCVSSLASMPFEMDAWEVDIAISGSQKGFMLTTGMAILGVSQKALAAMETANLPRTFFDFRDMMGANANGGFPYTPPLQLIFGMKESLDMLFDEGLENVYARHFRLAEGVRQAVAAWGLKLCANTPELASDSVSAIYVPEGFDSNELTAHAFDKYGVSFGIGLGEMNGKAFRIGHLGSLTDVMVLSGLATIEMAMADLDYPIQLGAGVAAAQEYFRKTAKKANA

SEQ ID NO: 368 - protein, 396 aa, Paracoccus denitrificans PD1222; identical to SEQ ID NO: 8
  MISC_FEATURE (1)..(396): chromosome 2

SEQ ID NO: 369 - protein, 396 aa, Roseobacter denitrificans OCh 114
MSDQNPVFIPGPTNIPDRLRAAMQVQTRDHRAPDFVDTFAPVLQDTKKVFGTTSGRVITFPASGTGGWEAALCNTLSPGDKVLVARYGMFSHRWIDMCERHGLDVQVIECPWGTGAPADKFEASLSDDKSHAIKAVLVTHNETATGVKSDVAGVRAAMDASAHPALLFVDCVSSLASMPFEMDAWGVDIAVSGSQKGFMLATGMAILGVSEKALAAMQTASLPRTFFDFRDMMGANASGGFPYTPPLQLIYGMRESLKMLFEEGLDNVYARHTRLAEGVRCAVKAWGLELVAQNPSLYSDTVSAIYVPEGFDSNALTDQAFNQYGVSFGVGLGEMNGKAFRIGHLGSLTDVMVLSGLATIEMAMADLDYPIELGSGVAAAQEHFRSKSGAAIKSAA

SEQ ID NO: 370 - protein, 399 aa, Ahrensia sp. R2A130
  MISC_FEATURE (1)..(399): contig00014
MSMQNPVFIPGPTNIPDELRRVIDFGTIDHRSSVFDEMLAPAIAGVKRILKTTDGEALVFPSTGTGAWEAAISNTLSPGDKVLVGCWGMFSHRWIDMCERHGLNVIVAEANWGDGVPLNAYAAALEGDTGHAIKAVLATHNETATGVKSDISAVRAVMNKAKHPALLMVDGVSSIASMDFRMDEWGVDLAIAGSQKGFMLPPGLAILGISQKAIAAMETAKLPRTFFDFRDMLTANGNGSFPYTPPVQLIRGLDHAIAMLESEGLDAVFARHARLAQGVREAVNAWCLKLCATSPDLYSDTVSAVLVPDGFDGTKVVTHAAEKYGVAFGVGLGEVSGKLFRIGHLGMLTDVMMCAGLSTAEMTMLDLGFPIKAGSGVTAAQEYYRNNPVATAQPMDKAA

SEQ ID NO: 371 - protein, 396 aa, Dinoroseobacter shibae DFL-12
MFDQNPIFIPGPTNVPDRLRRVMDMQTRDHRSPAFGAMLPELFDGVRKVFNTKDAAIITFPASGTGGWEAAVSNTLSPGDTVLIARYGMFSHRWIDLCQRHGLNVEIIECAWGSGAPADLFAERLKADKGHEIKAVLVTHNETATGVRSDIGAVRRGMDSADHPAMLMVDCVSSLASMPFDFDGWGVDVAITGSQKGFMLFTGMCIVAVSQKALEHRKTAKLPRTFFSFDDMLAANGAGGYPYTPPIQLMFGLQESLKMLFEEGLENVYARHFRLAEGVRRAVDAWGLRLCAESADLYSDTVSAIYVPKGFDSNALTQHAYDAYDISFGVGLGEMNGRAFRIGHLGALTDVTMLSGLATIEMAMADLDYPIELGSGVAAAQQFYRTTAGASLAKAA

SEQ ID NO: 372 - protein, 388 aa, Octadecabacter arcticus 238
MSFQNPVFIPGPTNMPEAIRQACYMPTIDHRSPLFGKILHPMLDGVRRVLKSETAKIFVFPSTGTGGWETALSNCLNAGDKVLAARNGMFSHRWIDMCQRHGLDVHIVETPWGHGLPATEYEAILKADKNHAIKVVLATHNETATGVKSDIAAVRKALVAAGHPAMLFVDGVSSIGSMDFRMDEWGVDVAVTGSQKGFMLPAGLAIVGFSDRAMQATKTSTLPRTFFDVHDMQKGYDNDAFPYTPPVGLMNGLKLALEMIEDEGLENVFARHRRIATGVRHAVKAWGLELCAVSPDVYSDTVSAVKTPDGFNATDIVTRAADKYGMAFGVGLGEVAGKVFRIGHLGMLTDAMMLSGLGVAEMVMVDLGLDIKLGSGVAAAQEFYRHGV

SEQ ID NO: 373 - protein, 396 aa, Artificial Sequence
  synthetic sequence
  MISC_FEATURE (1)..(396): pDaep_A276
MSFQNPVFIPGPTNMPEALRKAVDMPTLDHRSPLFGQILHPALAGVKKVLKSETAEIFVFPSTGTGGWETAITNTLNAGDKILAARNGMFSHRWIDMCQRHGLDVQVVETPWGAGIPADRYEEILTADKAHEIKVVLATHNETATGVKSDIAAVRRALDAAGHPALLFVDGVSSIASMDFRMDEWGVDIAVTGSQKGFMLPPGLAITGFSPKAMKAAETATLPRTFFDIKDMAKGYANSAYPYTPSVGLLNGLNMACGMLLDEGLENVFARHHRIAEGVRAAVRAWGLELCAVSPEVYSDSVSAIRTPEGFDANTFVSLAAEKYGVAFGTGLGEVAGKVFRIGHLGSLTDVMALSGIATAEMVMADLGLGIQLGSGVAAAQDYYRGNTASSAKAAA

SEQ ID NO: 374 - protein, 396 aa, Paracoccus sp. J56
MTSQNPIFIPGPTNIPEEMRKAVDMPTIDHRSPVFGRMLHPALEGVKKVLKSTQAEVFLFPSTGTGGWETAITNTLSPGDKVLAARNGMFSHRWIDMCQRHGLDVTFVETPWGEGIPADRFEEILTADKGHEIRVVLATHNETATGVKSDIAAVRRALDNAKHPALLFVDGVSSIGSMDFRMDEWGVDIAVTGSQKGFMLPPGLAIVGFSPKAMAAVETARLPRTFFDIRDMAQGYARNGYPYTPPVGLINGLNASCERLLSEGLENVFARHHRIAGGVRAAVEAWGLKLCAVRPELYSDSVSAIRVPEGFDANLIVSHALETYDMAFGTGLGQVAGKVFRIGHLGSLTDAMALSGIAVAEMVMADLGLPIKLGSGVAAAQEHYRQTTATALKKAA

SEQ ID NO: 375 - protein, 396 aa, Paracoccus aminophilus JCM 7686
MISQNPVFIPGPTNMPEALRRAVDIPTIDHRSAEFGRILHPALEGVKKVLKTKDAQVFVFPSTGTGGWETAISNTLSAGDKVLAARNGMFSHRWIDMCQRHNLDVTIVETPWGEGIPADRFEEILSADKGHEIRVVLATHNETATGVKSDIAAVRRALDAAGHPALLFVDGVSSIGSMDFRMDEWGVDIAVTGSQKGFMLPPGLAITAFSPKAMAAVESARLPRTFFDIRDMASGYARNGYPYTPPVGLINGLNESCKLLLAEGIDNVFARHRRIAEGVRKAVHAWGMELCAARPELYSDSVSAIKFPAGFDGNRFVSHAMDQYQVAFGTGLGEVAGKVFRIGHLGSLTDAMALLAISVAEMCLADMDLPVQLGSGVAAAQEHYRQTAGAALRKAA

SEQ ID NO: 376 - protein, 396 aa, Rhizobium rhizogenes YR147
MYMQNPVFIPGPTNMPEILRKAADMPTLDHRSPLFGEILRPALAGVKRVLKTEAASVYVFPSTGTGGWETAITNTLSPGDRVLAARYGMFSQRWIDMCQRHGLKVDIIEAAWGGGAPADRYEEILAADTAHEIKAVLVTHNETATGVKSEIAAVRRAIDAARHPALLFVDGVSSIASMDFRMDEWSVDIAVTGSQKGFMLPAGLAITAFSPKALAAVETAKLPRTFFDIRDMARSYANNAYPYTPAVGLLNGLKLSTELLLAEGLENVFARHRRIASGIRAAVRAWGLELCARSEDLYSDTVSAIRTPEGFDATSIVAHAARIYDVAFGVGLGEVAGKVFRIGHLGSLTDVMALSGIATAEMVMVDLGLNIKLGSGVAAAQEYYREGRASKIQAAA

SEQ ID NO: 377 - protein, 396 aa, Roseinatronobacter thiooxidans DSM 13087
MSAQNPVFIPGPTNIPEEIRKACDIPTLDHRSPAFARMFKPAVAGIRRVLGMQQGEVIILPSTGTGGWEAAITNSLSSGDRILTARFGMFSHRWIDMCQRHGLDVQVIEAPWGMGIPLAEMEAALRADTSHSIKAVLATHNETATGVKSDIAGLRRALDAAGHPALLFVDGVSSIGSMPFDMAGWGVDIAVAGSQKGFMLPAGLAILGVSPKALRAMDSATLPRTFFDFRDMLKAYAAGGYPYTPAVGLIAGLAKSIEMLEDEGLSHVYARHHRLAEATRRAVAAWGMSPCAATPDLYSDTVTAVVVPNGCDGTELVQLAATKYGVAFGVGLGEVAGKVFRIGHLGMLSDVMLLSGLATAEMCMADLGWKVQLGSGVAAAQDYLRKSANAALAEAA

SEQ ID NO: 378 - protein, 396 aa, Citreicella marina DSM 26424
MSFQNPVFIPGPTNIPERLRKACDMPTIDHRSPLFGQILHPAREGVRRVLKSDSAQIFIFPSTGTGGWETALSNCLSAGDTVLAARNGMFSHRWIDMCQRHGLGVEIVETPWGHGLPADRYEEILTADTGHRIKAVLATHNETATGVKSDIAAVRRALDAAGHPALLFVDGVSSIASMDFRFDDWGVDVAVTGSQKGFMLPPGLAITAFSAKAMAATDTATLPRTFFDVKDMAKGYANNAYPYTPAVGLLNGLNEACGMLLAEGLDNVFARHHRIAEGVRAAVRAWGLELCAVSPEVYSDTVSAIRTPEGFNATDIVSHAASAYGVAFGTGLGEVAGKVFRIGHLGSLTDVMALSGLATAEMVMADLGLDIRLGSGVAAAQDYYRGCRIETRKAAA

SEQ ID NO: 379 - protein, 396 aa, Ruegeria marina CGMCC 1.9108
MSDQNPVFIPGPTNIPDRLRRALQVQTRDHRAPDFVDTLAPVLSGIKTVLNTTDGNVVTFPSTGTGGWEAAITNTLSPGDRVLVARYGMFSHRWIDLCQRHGLDVRIIETDWGAGAPADRFEEELRADTGHRIKAVLVTHNETATGVLSDISAVRRAMDMAGHPALLFVDAVSSLASVPFRMDDWGVDIVVSGSQKGFMLTTGMAILGVSPKALGAIETARLPRTFFDFRDMMGANARGGFPYTPPLQLIYGMRESLNMLFEEGLENVYARHNRLAEGVRRAVDAWGLKLVAKSPELYSDTVSAIYVPDGFDSNALTDHAFHAYDVSFGIGLGEMNGRAFRIGHLGSLTDVMVLSGLATIEMAMADLNYPIRLGSGVAAAQEYLRRPAQAAAKSAA

SEQ ID NO: 380 - protein, 396 aa, Thalassobacter sp. 16PALIMAR09
MISQNPVFIPGPTNMPEVLRKSCDMPTLDHRSAAFADILHPALEGVKKVLKTTSAEVFVFPSTGTGGWETALTNTLSPGDTVLVGRNGMFSHRWIDMCERHGLDVIVLDTAWGQGLPVDRYGEVLAQDTEHRIKAVLATHNETATGVVSDIAGLRAAMDASAHPALLLVDGVSSIGSMNFEMDAWGVDIAVTGSQKGFMLPAGLAIVGVSQRALGAMATAKLPRTFFDLRDMQKGYAVNGYPYTPPVGLLNGLKLACDMLLEEGLENVFARHRRIADGVRAAVAAWGLELCAERPEWQSDTVSAVRTPEGFDAGEIVTHAAEVYDMAFGVGMGEVAGKVFRIGHLGMLTEAQALCGLATVEMCMVDLGLDIQLGSGVAAAQGVYRHGTRQQAMAAE

SEQ ID NO: 381 - protein, 396 aa, Salinihabitans flavidus DSM 27842
MSFQNPVFIPGPTNIPEALRRAVDMPTIDHRSALFAEILHPAREKVKAVLKSEAAEVFFFPSTGTGGWEVAITNTLCPGDRVLAARNGMFSQRWIDMCERHGLTVEVVETPWGDGIPADRFEEILTADAGHEIKAVLATHNETATGVTSDIAAVRRAMEAAGHPALLLVDGVSSIASMDFRMDEWGVDVAVTGSQKGFMLPAGLAIVGFSPRAMAAVERATLPRTFFDIRDMGRSYAANGYPFTPAVGLLNGLNQSCDMLLAEGLEAVFARHHRIAEGVRAAVRAWGLELCANAPELYSDSVSAIRTPEGVNATDIVTHAADVYGVAFGVGLGEVAGKVFRIGHLGSLTDVMALSGIATAEMCMADLGMDVTLGSGVAAAQEVYRRSAGNGRREAA

SEQ ID NO: 382 - protein, 396 aa, Paracoccus alcaliphilus DSM 8512
MSNQNPIFIPGPTNIPEVLRKAVDMPTIDHRSPVFGKILHPALEGVKKVLKSTQAEVFVFPSTGTGGWETAITNTLSAGDKVLATRNGMFSHRWIDMCQRHGLDVQVVMQEWGEGVPADKFEEILTADKGHEIKVVLATHNETATGVRSDIAAVRRALDAAGHPALLFVDGVSSIGCYDFRMDEWGVDIAVTGSQKGFMLPPGLAIVGFSPKAMAAVETAKLPRTFFDIRDMAKGYAANGYPYTPPVGLLNGLNVACEMLLEEGLENVFARHHRIAEGVRKAVSAWGLQLCAARPELYSDSVSAIRVPEGFDANKVVSHALNTYGVAFGTGLGDVAGKVFRIGHLGSLTDVMALSGIATAEMVMADLGLPVQLGSGVAAAQEHYRQSVAGAQQKAA

SEQ ID NO: 383 - protein, 396 aa, Paracoccus sp. PAMC 22219
VSTQNPIFIPGPTNIPEVLRKAVDMPTIDHRSPMFGKILHPALEGVKKVLKSTQAQVFFFPSTGTGGWETAITNTLSAGDAVLATRNGMFSHRWIDMCQRHRLDVQVVDQPWGEGIPTDRFEEILTADTAHRIKAVLATHNETATGVRSDIAAVRRALDRAGHPAMLFVDGVSSIACYDFRMDEWGVDVAVTGSQKGFMLPPGLAIVGFSPKAMAALDGAGLPRTFFDVRDMARGYAANGFPYTPPVGLLNGLKVATDMLLDEGLENVFARHHRIAEGVRQAVTAWGLTLCAARPALYSDSVSAIRTPDGFDANRIVSHALNTYGVAFGTGLGDVAGKVFRIGHLGMLTDVMALSGLATAEMVMVDLGLPVTLGSGVAAAQAHYRHSAGQACRQAA

SEQ ID NO: 384 - protein, 396 aa, Loktanella sp. 5RATIMAR09
MSFQNPVFIPGPTNMPEAIRKACDMPTIDHRSPLFGQILHPARAGVQEILKSETAEIFIFPSTGTGGWETALTNTLCAGDTVLAARNGMFSHRWIDMCQRHGLDMTIVETPWGHGVPADRYAEILQADKEHKIKVVLATHNETATGVKSDIAAVRKALDAANHPAMLFVDGVSSIGSMDFRFDEWGVDVAVTGSQKGFMLPAGLAIVGFSQKALAASKTAKLPRTFFDIADMTKGYAANAYPYTPAVGLMNGLLLATETLLKEGLENVFARHTRIASGVRAAVDAWGLDLCAASPDLYSDTVSAIKTPDGFNATDIVTHAAEKYGVAFGVGLGEVAGKVFRIGHLGSMTDVMALSGIATAEMCMVDLGLDIKLGSGVAAAQEYYRGTTGLKMRDAA

SEQ ID NO: 385 - protein, 387 aa, Psychrobacter urativorans R310.10B
MSQQNPIFIPGPTNIPDRLRRAMNVPSQDHRAPDFSDTFLPVLSGVKKVIGTQDGEVLLFTSSGTGGWEAAISNTLSPGDKVLIARYGMFSHRWIDMCQRHGLDVQVVECPWGTGAPADQFEAILSADTEHEIKAVMVTHNETATGVMSDISAVRKAMDSATHPALLFVDGVSSIASVPFEMDAWGVDVAVAGSQKGFMLATGMAVLGVSQKALSHMDEAKLPRTYFDFRDMLRANSNGGFPYTPPLNLIYGLRESLEMLSEEGLENVYARHYRLAEGVRQAVSAWGFKLCAQSPDLYSNTVSAIFVPEGFNSNELTDHAFNKYGISFGIGLGEMNGKAFRIGHLGSLTEVMVLAGLATIEMAMVDLDYPIKLGQGVAAAQEYYRNN

SEQ ID NO: 386 - protein, 396 aa, Leisingera sp. ANG-S
MSFQNPVFIPGPTNMPEALRKAVDMPTLDHRSPLFGQILHPALAGVKKILKSETAEIFVFPSTGTGGWETAITNTLNSGDKILAARNGMFSHRWIDMCQRHGLDVQVVETPWGEGLPADRYEEILTADTSHQIKAVLATHNETATGVKSDIAAVRRALDAAGHPALLFVDGVSSIASMDFRMDEWGVDIAVTGSQKGFMLPPGLAIVGFSPKAMKAAETATLPRTFFDIKDMANGYANSAYPYTPSVGLLNGLNMACGMLLDEGLENVFARHHRIAEGVRAAVRAWGLELCAVSPDVYSDSVSAIRTPDGFDANKFVSLAAEKYGVAFGTGLGEVAGKVFRIGHLGSLTDVMALSGIATAEMVMADLGLNIQLGSGVAAAQDYYRGNTASSTKAAA

SEQ ID NO: 387 - protein, 393 aa, Neptunomonas antarctica DSM 22306
MSDQNPVFIPGPTNIPDRVRHAMNVQTRDHRSPDFVKTFAPVLEDCKRVFGTEAGQVITFPSTGTGGWEAAICNTLSAGDTVLIARYGMFSHRWIDMCQRHDLHVEVIECPWGSGAPADLFRERLNKDSAHKIKAVLVTHNETATGVLSDIGAVRKAMNTTSHPAMLFVDCVSSLGSMPFKMDAWGVDIAIAGSQKGFMLTTGMAILAASPKALAAIETAQLPRTYFDFRDMMAANKNGGFPYTPPLQLIYGLKESLTMLFDEGLDNVYARHFRLAEGVRQAVAAWGFKLCANAPELYSHSVSAIYVPEGFDSNKLTDHAFNAYGVSFGIGLGEMNGKAFRIGHLGSLTEVMVLSGLAAIEMAMADLDYPITLGSGVAAAQEYFRKTAAANIG

SEQ ID NO: 388 - protein, 396 aa, Sinorhizobium fredii CCBAU 83753
MHMQNPVFIPGPTDMPEVLRKASDMPTIDHRSSLFGEILRPALAGVQKVVKSEAASIFVFPATGTGGWETAITNTLSPGDRVLAARNGMFSHRWIDMCQRHGLNVEIILASWGSGAPAERYEEILVADKAHEIKAVLVTHNETATGVRSDVAAVRRAIDAARHPALLFVDGVSSIASMDFRMDEWGVDVAVTGSQKGFMLPAGLAITAFSPKALAALETAKLPRTFFDVRDMAKSYAGNAYPYTPAVGLLNGLKVSTEILLAEGLENVFARHTRIASGVRAAVGAWGLELCATSEDLYSDTVSAIRTPEGFDATSVVTHAAKKYDVAFGVGLGEVAGKVFRIGHLGSLTDVMALSGIATAEMVMADLGLGVRLGSGVAAAQEYYRNNQVSAVQGTA

SEQ ID NO: 389 - protein, 396 aa, Sinorhizobium fredii CCBAU 83753
MSGYNHLFIPGPTNIPEQVRQAMNLPMEDMRSPRFPELTLPLFADVKKVFKNRNGRVFIYPSSGTGAWEAAMTNVLSPGDKVLMSRFGQFSHLWVDMAERLGFEVDCLDREWGTGVPVELYAERLAADKAHKIKAVFVTHNETATGVTSDVAAVRAALDACGHPALLFVDGVSSIGSIDFRQDEWGVDCAVSGSQKGFMLPAGLGFLSVSQKALDAAKTARHMRCYFSFEDMIKTNDTGYFPYTPPTQLLRGLRAALDLIFEEGLENIFARHHHLADGVRAAVSAWGLKLCATEPKWHSDTVSAIRLPEGVDGVEVIRHAYRTYNTSLGSGLSKVAGKVFRIGHLGSLNEVMVLGALSAAELTLLDCGVKIEPGVGVGAAIRQFRSAAATATAEAA

SEQ ID NO: 390 - protein, 396 aa, Defluviimonas indica DSM 24802
MSFQNPVFIPGPTNIPESLRKACDMPTIDHRSPLFGQILHPAREGVRKVLKSESAEVFIFPSTGTGGWETALSNTLSAGDKVLAARHGMFSDRWIDMCRRHGLDVQVVETPWGEGLPADRFEEILTKDKGHEIKAVLATHNETATGVKSDIAAVRRALDQAGHPAMLFVDGVSSIASIDFRFDAWKVDVAVAGSQKGFMLPAGLAIVGFSEKAMDATRTSTLPRTFFDVNDMAKGYKNNGYPYTPAVGLLNGLNQACGMLLQEGLENVFARHHRIAQGVRAAVGAWGLELCAVDPSVYSDTVSAVRTPAGFNATDIVTHAAHKYGVAFGVGLGEVAGKVFRIGHLGSLTDVMALSGIATAEMCMADLGLKIELGSGVAAAQDYYRGHAAVARKDAA

SEQ ID NO: 391 - protein, 393 aa, Marinomonas sp. S3726
MSEQNPVFIPGPTNIPNRLLNAMHIQTQDHRSPNFVETLTPVLEGCKKVFGTTTGEVITFPSTGTGGWEAAISNTLSAGDKVLIARYGMFSHRWIDLCQRHGLEVVVIECPWGDGAPADLFEAALNEDSNHDIKAVLVTHNETATGVRSDIAAVRKAMNNVNHPAMLFVDCVSSLASMPFEMDAWEVDIAISGSQKGFMLTTGMAILGVSQKALAAMETANLPRTFFDFRDMMGANANGGFPYTPPLQLIFGMKESLDMLFDEGLENVYARHFRLAEGVRQAVAAWGLKLCANTPELASDSVSAIYVPEGFDSNELTAHAFDKYGVSFGIGLGEMNGKAFRIGHLGSLTDVMVLSGLATIEMAMADLDYPIQLGAGVAAAQEYFRKTAKKANA

SEQ ID NO: 392 - protein, 396 aa, Oceanicola flagellatus CGMCC 1.12644
MSFQNPVFIPGPTNMPEAVRQACYMPTIDHRSPTFGKILHPCLDGVRKVLKSDSAKIYIFPSTGTGGWETALSNTLNKGDKVLAARNGMFSHRWIDMCQRHGLDVHVVETPWGEGLPADKYEEILKADKSHEIKVVLATHNETATGVKSDIAAVRKALDAAGHPAMLFVDGVSSIASMDFRFDEWGVDVAVTGSQKGFMLPAGLAIVGFSDKAVQATKSATLPRTFFDINDMQKGYDNNAFPYTPPVGLMNGLKLSLDMLLDEGIENVFARHHRIAEGVRKAIGAWGLELCAASPDVYSDTVSAIRTPEGFNATDIVTVAANDYGMAFGVGLGEVAGKVFRIGHLGSLTDAMMLSGLGVAEMVMVDLGLDVKLGSGVAAAQEYYRRDLKNGSKAAA

SEQ ID NO: 393 - protein, 396 aa, Phaeobacter inhibens S4Sm
MSFQNPVFIPGPTNIPESLRKACDMPTIDHRSPLFGQILHPARDGVRKVLKSEVAEIFIFPSSGTGGWETALTNTLSEGEKILAARNGMFSHRWIDMCQRHRLDVQIVETPWGEGLPADRYEEILAADKSHQIKAVLATHNETATGVKSDIAAVRKALDAAGHPALLFVDGVSSIASMDFRFDEWGVDVAVTGSQKGFMLTAGLAIVGFSPKAMDATKTGTLPRTFFDVHDMAKGYANNAYPYTPAVGLMNGLNESCKMLLSEGLENVFARHTRIAQGVRAAVTAWELELCAVSPDVYSDTVSAIKTPDGFNATDIVTHAAETYGVAFGVGLGEVAGKVFRIGHLGSLTDVMTLSGIATAEMCMADLGLDVPLGSGVAAAQEYYRSNPAATALKAA

SEQ ID NO: 394 - protein, 396 aa, Brevirhabdus pacifica DSM 27767
MSFQNPVFIPGPTNIPEVIRKACDMPTIDHRSSVFGEIFAPVRENLKKVLKTTSGEIIIFPASGTGAWEASISNTLSPGDKVLAARNGMFSHRWIDMCQRHGLEVQIVETPWGEGIPANKYQEILAADKGHEIKAVLATHNETATGVRSDIGAVRAAMDAAKHPALLMVDGVSSVASMDFRMDDWGVDLAVTGSQKGFMMPAGLAICGVSQKALSHMDAAKLPRTFFDFRDMLNAYAAGGYPYTPAVGLLNGLNTSVNMLLDEGLEAVFDRHHRIAEGVRRAIAAWGLKPCAANPSLYSDTVTAVVVPEGFNGSAVATHAAEAYGMAFGVGLGEVATKVFRIGHLGSLTEAMMLSGLSVAEMSMVDLGIPVKLGSGVAAAQEYYRVGSAAMQAAAE

SEQ ID NO: 395 - protein, 396 aa, Methylobacterium radiotolerans SB3
MFAQNPVFIPGPTNMPEVLRRAADMPTLDHRSPLFAQILHPALAGVKGVLKSQDAEVFVFPSTATGGWETALSNTLSAGDAVLAARHGMFSHRWIDMTRRHGLDVRVIEAPWGEGLPADRFAEALAADTAHRIRAVLVTHNETATGVRSDVAAVRRALDASGHPALLLVDGVSSIASMDFRMDEWGVDVAVTGSQKGFMLPAGLAIVAFSPRAMAATATATLPRTYFDVRDMAKGYPNGAYPYTPAVGLLNGLKLSTELLLAEGLDNVFARHRRIADGIRAAVAAWGLELCAARPDLYSDTVSAICAPEGFDATRIVTHAARHYDVAFGVGLGEVAGKVFRIGHLGSLTDVMALSGIAAAEMAMADLGLRIELGSGVAAAQAVYRRAPAAGLRAAA

SEQ ID NO: 396 - protein, 396 aa, Pelagimonas varians DSM 23678
MSFQNPVFIPGPTNIPEALRKACDMPTIDHRSPLFGQILHPARRGVRQVLKSDTAKVFIFPSTGTGGWETALTNCLSAGDKVLAARNGMFSHRWIDMCQRHGLDVQIVETPWGDGLPADRYEEILTADTSHQIKVVLATHNETATGVKSDIAAVRKALDAAGHPALLFVDGVSSIGSMDFRFDDWSVDVAVAGSQKGFMLPAGLAIVGFSAKAMEATKTAALPRTFFDVHDMAKGYDNNAYPYTPAVGLLNGLNEACTMLLAEGLENVFARHTRIATGVRAAVDAWGLNLCAASPDVYSDTVSAICTPDGFNATDIVTHAAETYGVAFGVGLGEVAGKVFRIGHLGSLTDVMTLSGIATAEMCMVDLGLDIKLGSGVAAAQEFYRLNPAARLQNAA

SEQ ID NO: 397 - protein, 396 aa, Thalassobius mediterraneus 5120
MSFQNPVFIPGPTNMPEVLRKAVDMPTLDHRSPLFGQILHPAIAGVKQVLKSKSAEVFIFPASGTGGWETALTNTLSAGDKILAARNGMFSHRWIDMCQRHDLDVTIVETPWGEGLPADRYEEILTADTNHEIQAVLATHNETATGVKSDIAAVRRALDAAGHPALLFVDGVSSIASMDFRMEEWGVDVAVTGSQKGFMLPAGLAIVGFSPKAMEVIETAKLPRTFFDVRDMAAGYANNAYPYTPAVGLLNGLKLSCDMLLGEGLENVFARHNRIASGVRAAVGAWGLDLCAASPDVYSDSVSAIRTPEGFNATDIVTLAAEKYGVAFGVGLGEVAGKVFRIGHLGSLTDVMALSGIATAEMCMVDLGLDITLGSGVAAAQDYYRNQDAAPAKAAA

SEQ ID NO: 398 - protein, 396 aa, Jannaschia sp. CCS1
MSFQNPVFIPGPTNMPERIRTACDMPTIDHRSPTFGRILHPCLENVRKILKSDNAHIFIFPSTGTGGWETALTNTLSPGDKVLAARNGMFSHRWIDMCQRHQLDVDIVETPWGAGLPAERYAEILAADTAHEIKVVLATHNETATGVKSDIAAVRRALDDAGHPALLFVDGVSSIASMDFRFDEWGVDIAVTGSQKGFMLPAGLAIVGFSDKAKAASETATLPRTFFDIKDMAGGYAANAFPYTPPVGLMRGLKLATDLLLEEGLENVFARHHRIAEGVRRAVDAWGLELCAQSADVQSDTVSAIKTPEGFDATDIVTRAAETYGVAFGVGLGEVAGKVFRIGHLGSLTDVMALSGLATAEMCMVDLGLDIKLGSGVAAAQEYYRTNPAQSALPVD

SEQ ID NO: 399 - protein, 398 aa, Mesorhizobium sp. BNC1
MVVSTQNPIFIPGPTNIPEVLRKAVDMPTIDHRSPLFGKILHPAIEGVKKVLKTKQAKLFVFPSTGTGGWETAITNVLSPGDKVLATRNGMFSHRWIDMCQRHGLDVIVVPQDWGESVPADRFEEILAADKAHKIKAVLATHNETATGVRSDIAAVRHAMDAAAHPALLLVDGVSSIASMDFRMDEWGVDIAVTGSQKGFMLPPGLAILGFSPKALEAVEAAKLPRTFFDIRDMARSYANNGYPYTPPVGLLNGLKIASEMLLEEGMENVFARHHRIAEGIRQAVAAWGLRLCAVRPELYSDTVSAIRVPDGFDGNRVVAHALNVYGVAFGTGLGDVAGKVFRIGHLGSLTDVMALSGIATAEMVLVDLGLPIKLGSGVAAAQEHYRLSAGNAQKRAA

SEQ ID NO: 400 - protein, 397 aa, Roseovarius sp. TM1035
MSDQNPVFIPGPTNIPDRLRRAMQVQTQDHRSPAFVNTLAPVLKGCKTVFGTAKGEIITFPASGTGGWEAAITNTLSPGDKVLVARYGMFSHRWIDMCQRHGLDVQIIECPWGSGAPADRFQEALSADKDHSIKAVLVTHNETATGVRSDIAAVRGAMKASNHPALLMVDCVSSLGSMPFEMDTWGVDIAVSGSQKGFMLNTGMAILAVSPKALAMMETAKLPRTFFDFRDMMGANAKGGFPYTPPLQLIYGMAESLNMLFEEGLDNVYARHTRIAEGVRRAVAAWGLKLVAQTPDLYSDTVSAVFVPEGFDSNRLTERVFGTYGMSFGVGLGEMNGRAFRIGHLGSLTESMMLSGLATLEMAMADLNYPVKMGSGVIAAQEYYRATAKPVLAEKAA

SEQ ID NO: 401 - protein, 396 aa, Methylobacterium radiotolerans JCM 2831
  MISC_FEATURE (1)..(396): plasmid pMRAD01
MFAQNPVFIPGPTNMPEVLRRAADMPTLDHRSPLFAQILHPALAGVKTVLKSQDAEVFVFPSTATGGWETALSNTLSAGDAVLAARHGMFSHRWIDMTRRHGLDVRVIEAPWGEGLPADRFAEALAADTAHRIRAVLVTHNETATGVRSDVAAVRRALDASGHPALLLVDGVSSIASMDFRMDEWGVDVAVTGSQKGFMLPAGLAIVAFSPRAMAATATATLPRTYFDVRDMAKGYPNGAYPYTPAVGLLNGLKLSTELLLAEGLDNVFARHRRIADGIRAAVAAWGLELCAARPDLYSDTVSAICAPEGFDATRIVTHAARHYDVAFGVGLGEVAGKVFRIGHLGSLTDVMALSGIAAAEMAMADLGLRIELGSGVAAAQAVYRRAPAAGLRAAA

SEQ ID NO: 402 - protein, 395 aa, Rhizobium sp. NGR234
MSGYNHLFIPGPTNIPEQIRQAMNLPMEDMRSPRYPELTLPLFADVKKVFKNRNGRVFIYPSSGTGAWEAAMTNVLSPGDRVLMSRFGQFSHLWVDMAERLGLEVDCLDREWGTGVPVDLYTERLAADKAHRIKAVFVTHNETATGVTSDVAAVRAALDASGHPALLFVDGVSSIGSIDFRQDEWGVDCAVSGSQKGFMLPAGLGFLSVSQKALEAAKTARHMRCYFSFEDMIKTNDTGYFPYTPPTQLLHGLRAALDVIFEEGLENIFARHRHLADGVRAAVSAWGLKLCATEPKWYSDTVSAIRLPEGIDGVKVIRHAFDTYNTSLGSGLSKVAGKVFRIGHLGSLNEVMVLGALSAAELTLLDCGVKIEPGAGVGAAIRQFRAAATATAKAA

SEQ ID NO: 403 - protein, 396 aa, Rhizobium sp. NGR234
  MISC_FEATURE (1)..(396): plasmid pNGR234b
MHQQNPVFIPGPTNMPEVLRKASDMPTIDHRSPMFGEILRPGLAGVKKVLKSEAASIFVFPATGTGGWETAITNTLSPGDRVLAARNGMFSHRWIDMCQRHGLNVEIILASWGSGAPADRYEEILAADKAHEIKAVLVTHNETATGVRSDIAAVRRAIDAARHPAMLFVDGVSSIASMDFRMDEWGVDIAVTGSQKGFMLPAGLAITAFSPKALAALETAKLPRTFFDVRDMSKSYENNAYPYTPAVGLLNGLKVSTEILLAEGLENVFARHKRIASGVRAAVRAWGLELCATSEDLYSDTVSAIRTPEGFDATSVVTHAAKKYDVAFGVGLGEVAGKVFRIGHLGSLTDVMALLGIATAEMVMADLGLAIKLGSGVAAAQEFYRSSHVPAGQGAA

SEQ ID NO: 404 - protein, 396 aa, Citreicella sp. SE45
  MISC_FEATURE (1)..(396): genomic scaffold scf_1113211290443
MSFQNPVFIPGPTNIPESLRKACDMPTIDHRSPLFGQILHPAREGVRKVLKSDAAEVFIFPSTGTGGWETALSNTLSPGETVLAARNGMFSHRWIDMCQRHGLSVEIVETPWGEGLPAHRYAEILAADTQHRIKAVLATHNETATGVRSDIAAVRRALDDAGHPALLFVDGVSSIASMDFRFDEWGVDCAVAGSQKGFMLPPGLAIVGFSDKAMAATQTARLPRTFFDVQDMAKGYANNAYPYTPAVGLLNGLNEACRMLLDEGLENVFARHHRIAEGVRCAVRAWGLELCAASPEVYSDTVSAIRTPDGFNATDIVSHAAQTYGVAFGTGLGEVAGKVFRIGHLGSLTDVMTLSGLATAEMCMKDLGLDITLGSGVAAAQEFYRATPALARKAAA

SEQ ID NO: 405 - protein, 396 aa, Artificial Sequence
  synthetic sequence
  MISC_FEATURE (1)..(396): pCaer_C109
MSFQNPVFIPGPTNMPEALRKAVDMPTLDHRSPLFGQILHPALAGVKKVLKSETAEIFVFPSTGTGGWETAITNTLNAGDKILAARNGMFSHRWIDMCQRHGLDVQVVETPWGEGLPADRYEEILTADTSHQIKVVLATHNETATGVKSDIAAVRRALDAAGHPALLFVDGVSSIASMDFRMDEWGVDIAVTGSQKGFMLPPGLAIVGFSPKAMKAAETATLPRTFFDIKDMANGYANSAYPYTPSVGLLNGLNMACGMLLDEGLERVFARHHRIAEGVRAAVRAWGLELCAVSPDVYSDSVSAIRTPDGFDANKFVSLAAEKYGVAFGTGLGEVAGKVFRIGHLGSLTDVMALSGIATAEMVMADLGLDIPLGSGVAAAQDYYRGNTASSAKAAA

SEQ ID NO: 406 - protein, 396 aa, Ensifer fredii USDA257
MSGYNHLFIPGPTNIPEQVRQAMNLPMEDMRSPRYPELTLPLFADVKKVFKNHSGRVFIYPSSGTGAWEAAMTNVLSPGDRVLMSRFGQFSHLWVDMAERLRFEVDCIDREWGTGVPVELYAERLAADKAHKIKAVFVTHNETATGVTSDVAAVRASLDACGHPALLFVDGVSSIGSIDFRQDEWGVDCAVSGSQKGFMLPAGLGFLSVSAKALEAARTARHMRCYFSFDDMIKTNDAGYFPYTPPTQLLRGLRASLDLIFEEGLENIFARHHYLANGVRAAVSAWDLQLCATEPKWHSDTVSAIRLPEGVDGVEVIRHAYRTYNTSLGSGLSKVAGKIFRIGHLGSLNEVMVLGALSAAELTLLDCGVKIEPGSGSGAAIKQFRSAATASTAKAA

SEQ ID NO: 407 - protein, 396 aa, Ensifer fredii USDA257
MYLQNPVFIPGPTNMPEVLRKASDMPTIDHRSPLFGEILRPALAGVKKVVRSQSASIFVFPATGTGGWETAITNTLSPGDRVLVARYGMFSHRWIDMCQRHGLDVSVIETPWGSGAPVDRYEEMLTADKAHQIKAVLVTHNETATGVKSDIAALRRALDAARHPAMLFVDGVSSIASMEFRMDDWGVDVAVTGSQKGFMLPAGLAITAFSPKALAAIETAKLPRTFFDVRDMSKSYENNAYPYTPVVGLLNGLKVSTEMLLAEGLENVFARHNRIATGIRAAVRAWGLELCAMSEDLYSDTVSAIRTPDGFDATSVVTHAAKKYDVAFGVGLGEVAGKVFRIGHLGSLTDVMALSGIATAEMVMADLGLAIKLGSGVAAAQDYYRNNQVSAGNGAA

SEQ ID NO: 408 - protein, 396 aa, Paracoccus pantotrophus J46 ICCP
MTSQNPIFIPGPTNIPEEMRKAVDMPTIDHRSPVFGRMLHPALEGVKKVLKTTQAQVFLFPSTGTGGWETAITNTLSPGDKVLAARNGMFSHRWIDMCQRHGLDVTFVETPWGEGIPADRFEEILTADKGHEIRVVLATHNETATGVKSDIAAVRRALDAAKHPALLFVDGVSSIGSMDFRMDEWGVDIAVTGSQKGFMLPPGLAIVGFSPKAMAAVESARLPRTFFDIRDMATGYARNGYPYTPPVGLINGLNASCERILAEGLENVFARHHRIASGVRAAVEAWGLKLCAVRPELYSDSVSAIRVPEGFDANLIVSHALETYDMAFGTGLGQVAGKVFRIGHLGSLTDAMALSGIATAEMVMADLGLPIKLGSGVAAAQEHYRQTTAAAQKKAA

SEQ ID NO: 409 - protein, 396 aa, Paracoccus sp. J4
MTSQNPIFIPGPTNIPEEMRKAVDMPTIDHRSPVFGRMLHPALEGVKKVLKTETALVFLFPSTGTGGWETAITNTLSPGDKVLAARNGMFSHRWIDMCQRHGLDVTYVETPWGEGIPADRFEEILTADKGHEIRVVLATHNETATGVKSDIAAVRRALDAAKHPALLFVDGVSSIGSMDFRMDEWGVDIAVTGSQKGFMLPPGLAIVGFSPKAMEAVESARLPRTFFDIRDMATGYARNGYPYTPPVGLINGLNLSCERLLAEGLENVFARHRRIAGGVRAAVEAWGLKLCAVRPELYSDSVSAIRVPEGFDANLIVSHALETYDMAFGTGLGQVAGKVFRIGHLGSLTDAMALSGIATAEMVMADLGLPIRLGSGVAAAQEHYRQTTAAAQKKAA

SEQ ID NO: 410 - protein, 396 aa, Paracoccus sp. N5
MTSQNPIFIPGPTNIPEEMRKAVDMPTIDHRSPVFGRMLHPALEGVKKVLKTESAQVFLFPSTGTGGWETAISNTLSPGDKVLAARNGMFSHRWIDMCQRHSLDVTYVETPWGEGIPADRFEEILTADKGHEIRVVLATHNETATGVKSDIAAVRRALDAAKHPALLFVDGVSSIGSMDFRMDEWGVDIAVTGSQKGFMLPPGLAIVGFSPKAMEAVETARLPRTFFDIRDMATGYARNGYPYTPPVGLINGLNVACERLLSEGLENVFARHNRIASGVRAAVEAWGLKLCAVRPELYSDSVSAIRVPEGFDANRIVSHALETYDMAFGTGLGEVAGKVFRIGHLGSLTDAMALSGIATAEMVMADLGLPVKLGSGVAAAQEHYRQSTAAALKKAA

SEQ ID NO: 411 - protein, 397 aa, Roseovarius mucosus DSM 17069
MSDQNPVFIPGPTNIPDRLRRAMQVQTQDHRSPAFVNTLAPVLKGCKTVFGTAKGEIITFPASGTGGWEAAITNTLSPGDKVLVARYGMFSHRWIDMCERHGLDVQIIECPWGSGAPADRFQEALTADKGHSIKAVLVTHNETATGVVSNIAAVRAAMKAAKHPALLMVDCVSSLGSMPFEMDTWGVDIAVSGSQKGFMLNTGMAILAVSPKALAMMETAKLPRTFFDFRDMMGANAKGGFPYTPPLQLIYGMAESLNMLFEEGLDNVYARHTRIAEGVRLAVAAWGLKLVAQTPDLYSDTVSAVFVPEGFDSNRLTERVFSTYGMSFGVGLGEMNGRAFRIGHLGSLTESMMLSGLATLEMAMADLNYPVKMGSGVIAAQEYYRSTAKPVLAEKAA

SEQ ID NO: 412 - protein, 389 aa, Marinobacter sp. BSs20148
MSDQNPIFIPGPTNIPDRLRFAMNVQSSDHRSPGFVETLSPLLQDCKKVFNTQSGEVILFPASGTGGWEAAICNTLSPGDKVLIARYGMFSRRWIEMCQRHGLDVQIIECPWGSGAPANEFKRALSADTQHKIKAVLVVHNETATGVTSDIDAVRQAMDSCSHPALLLVDCVSSLASMPFEMDNWGVDIAVSGSQKGFMLITGMAILAVSQKALAAMETAKLSCAFFDFRAMMTANAQGGFPYTPPLQLIYGLKESLKMLFEEGLDNVYARHFRLAEGVRQAAHAWGMALCAQSPDLYSNTVTAIYVPEGFDSNELTDHTFAKYGVSFGIGLGEMHGKAFRIGHLGSLTDSMVLSGLATIEMAMADLDYPIELGSGVRAAQNHFRATTA

SEQ ID NO: 413 - protein, 397 aa, Ensifer sp. USDA 6670, CC2017
MYLQNPVFIPGPTNMPEVLRKASDMPTIDHRSPLFGEILRPALAGVKKVVKSQSASIFVFPATGTGGWETAITNTLSPGDRVLVARYGMFSHRWIDMCQRHGLDVSVIETPWGSGAPVDRYEEMLTADKAHQIKAVLVTHNETATGVKSDIAAVRSALDAARHPAMLFVDGVSSIASMEFRMDDWGVDVAVTGSQKGFMLPAGLAITAFSPKALAALETAKLPRTFFDVRDMSKSYENNAYPYTPAVGLLNGLKVSTEMLLAEGLENVFARHNRIATGIRAAVRAWGLELCAMSEDLYSDTVSAIRTPDGFDATSVVTHAAKKYDVAFGVGLGEVAGKVFRIGHLGSLTDVMALSGIATAEMVMADLGLSIKLGSGVAAAQDYYRNNQVSAGRGERL

SEQ ID NO: 414 - protein, 396 aa, Rhizobium etli CNPAF512
MYTQNPVFIPGPTNMPEVLRRAADLPTIDHRSAAFADILQPALAGVRKVVKSENAEIVVFPATGSGGWEAAITNLLSPGDKVLAARHGMFSHRWIDMCQRHGLQVDAVHSSWKQPLPLAEYEKRLFADKGHDIKAVLVTHNETATGVKSDVGAVRRLLDEARHPALLLVDGVSSIASMDFRMDEWKVDAAITGSQKGFMLPVGLAILALSPKAMQAAQSAKLHRAFFDIREMAKTYPSSGYPYTPSIGLLNGLKVSTELLLGEGLDNVFKRHARIASGVRAAVSAWGLRLYAQEASSYSDTVSAVETPEGFDATSIVTHAAQKYAVAFGAGLGDVAGRVFRIGHLGSMSDVMALSGIAAAEMAMADLGLPIRLGSGVAAAQEIYRNTAATPARNAA

SEQ ID NO: 415 - protein, 396 aa, Sulfitobacter sp. 20_GPM-1509m
MSFQNPVFIPGPTNIPENLRKACDMPTIDHRSPLFGQILHPARAGVRKVLKSTSAEVFIFPSTGTGGWETALTNTLSAGDTVLAARNGMFSQRWIDMCQRHGLNVNVVETPWGQGVPADRYAEILAADTGHQIKAVLATHNETATGVRSNIAAVRHALDTAGHPAMLFVDGVSSIGSMEFRFDDWGVDVAVTGSQKGFMLPAGLGIVGFSAKAMEATKSAKLPRTFFDVHDMAKGYANNAYPYTPAVGLLNGLNTACGMLLSEGLDAVFARHHRIAEGVRAAVGAWGLELCAASPDLYSDTVSAIRTPEGFNATDIVTHAAEAYGVAFGVGLGEVAGKVFRIGHLGSLTDVMMLSGIATAEMCMADLGLDITLGSGVAAAQDYYRANRTVRQQDAA

SEQ ID NO: 416 - protein, 395 aa, Maribius sp. MOLA 401
MSFQNPVFIPGPTNMPEAIRKACDMPTIDHRSPLFGGILHPCLDGVRKVLKSDAAHVFIFPATGTGGWETALTNTLSPGDRVLAARNGMFSHRWIDMCQRHKLDVDVVETPWGHGVPADRYEEILTADTGHGIKAVLATHNETATGVKSDIAAVRRALDAAGHPALLLVDGVSSIGSMDFRFDDWGVDVAVTGSQKGFMLPAGLAIAGFSDKAMEATATAALPRTFFDVKDMQKGYDSDAFPYTPPVGLMNGLRLSLDMLLDEGLENVFARHHRIAEGVRRAVGAWGLELCAASPELYSDSVSAIRTPEGFNATDIVTLAARDYGMAFGVGLGEVAGKVFRIGHLGMLTDAMMLSGLGVAEMAMVDLGLDITLGSGVAAAQEHYRHGNTARKAAA

SEQ ID NO: 417 - protein, 393 aa, Amphritea atlantica DSM 18887
MTDQNPVFIPGPTNIPDRLRNAMHLQTRDHRAPDFVETFAPVLRDCKRVFGTETGEVITFPSSGTGGWEASICNTLSAGDKVLIARYGMFSHRWIDLCQRHNLDVQVIECAWGSGAPADKFAEVLSADNGHEIKAVLVTHNETATGVKSDIAAVRQAMDASGHPALLFVDCVSSLASMPFEMDAWGVDIAVSGSQKGFMLNTGMAILGVSQKALAAMETATLTRTFFDFRDMMAANANGGFPYTPPLQLIYGMKESLAMLFEEGLENVYARHHRLAEGVRKAVDAWGLKLCAQSPELYSDTVSAIYVPEGFDSNQLTEHAFNAYGVSFGIGLGEMNGKAFRIGHLGSLTDVMVLSGLATIEMAMADLNYPITLGSGVAAAQEYFRKTASKNCA

SEQ ID NO: 418 - protein, 396 aa, Rhodobacteraceae sp. HL-91
MSLQNPVFIPGPTNMPESLRKACDMPTIDHRSPAFAAVFQPAVAGVKEVLGMEAGEVLLLPATGTGGWEAAISNALSPGDKVLAARHGMFSHRWIDLCQRHGLDVQIIEAPWGEGCPTDAMGEALAADTDHSIKAVLATHNETATGVRSDIAGLRAAMDKAGHPALLLVDGVSSIASMPFEMDAWGVDIAVAGSQKGFMLPAGLAILGVSSKALAARDSATLPRTYFDFGDMLKGYAAGGYPFTPPVGLINGLAASIAMLQAEGLDNVYARHHRLAEATRRAVGGWGLKVCAARPDLYSDTVTGVMAPEGFNGTDVVTLAASKYGVAFGVGLGEVAGKLFRIGHLGSLTDVMLLSGLATAEMCMADLGWPVKLGSGVAAAQEYLRGTTAESIAKAA

SEQ ID NO: 419 - protein, 396 aa, Methylobacterium sp. UNCCL143
MFAQNPVFIPGPTNMPEVLRRAADMPTLDHRSPLFAQILHPALAGVKKVLKSEDAEVFIFPSTATGGWETALSNTLSAGDTVLAARHGMFSHRWIDMTRRHGLDVRMIEAPWGEGLPADRFAEALAADKAHRIRAVLVTHNETATGVRSDVAAVRRALDASNHPALLLVDGVSSIASMDFRMDEWGVDVAVTGSQKGFMLPAGLAIVAFSPKAMAATATATLPRTYFDIRDMAKGYPNGAYPYTPAVGLLNGLKLSTELLLAEGLETVFARHRRIADGIRAAVAAWGLELCAARPDLYSDTVSAIRTPEGFDATRIVTHAARHYDVAFGVGLGEVAGKVFRIGHLGSLTDVMALSGIAAAEMAMADLGLRIALGSGVAAAQAVYRRAPAAALRAAA

SEQ ID NO: 420 - protein, 396 aa, Aquisalimonas asiatica CGMCC 1.6291
MENQNPVFIPGPTNIPERLRKAMSVPTWDHRSPEFGRMFVPLLQDLKQPFGTTRGDVAVFTASGTGGWETAITNTLSPGDTVLAARYGMFSHRWIDLCERHGLDVKVIDCGWGEGAPIAAYRDALAADTDHRIKAVLSVHNETATGVRSDVGAVREAMDAADHPAMLFVDGVSSIGSMEFRMDDWGVDMAVAGSQKGFMLATGLAIVAASPKAQAAMETAQLPRCYFDLRDMLAAGGKGSYPYTPAIGLIEGLRESVNMLLAEGLDNVHARHFRIAEGVRRAVAAWGMEVCARHPELNSDTVTAIMVPDGFDSTELVNYANETYGVSFGIGLGQVAGQLFRIGHLGQMSDVMALSGIATAEMAMKDLGYPIELGSGVAAAQEYYRANSAVAQRKTA

SEQ ID NO: 421 - protein, 396 aa, Roseovarius lutimaris DSM 28463
MSDQNPVFIPGPTNMPDRLRRAMQVQTQDHRSPAFVETLTPVLEGCKTVFRTTTGTIITFPASGTGGWEAAISNTLSPGDTVLVARYGMFSHRWIDMCQRHGLNVQIIECPWGSGAPADKFQEALSADADHAIKAVLVTHNETATGVKSDIAAVRRAMNTANHPAMMFVDCVSSLGSMEFRMDDWGVDIAVSGSQKGFMLATGMAILAVSPKAIAAMDTAKLPRTFFDFRDMMSANAGGGYPYTPPLQLIYGMAESLKMLFEEGLENVYARHHRLATGVRRAVDAWGLRLVAQSPELYSDTVSAVFVPEGFDSNALIEHVFATYGVSFGIGMGEMNGRAFRIGHLGSLTDTMVLSGLATIEMAMADLGYPVKLGSGVVAAQEYFRATTKPALAKAA

SEQ ID NO: 422 - protein, 396 aa, Halocynthiibacter sp. PAMC 20958
MSFQNPVFIPGPTNMPEAVRQACYMPTIDHRSPTFGKILHPCLEGVQQVLKSDTAKVFIFPSTGTGGWETALSNTLSKGDKVLAARNGMFSHRWIDMCQRHGLDVQIVETAWGEGLPADRYEEILRADKSHDIKVVLATHNETATGVKSDIAAVRRALDAAGHPALLFVDGVSSIASMDFRFDEWGVDVAVTGSQKGFMLPAGLAILGFSDKSIAASKNAGLPRTFFDIKDMQNGYNANAFPYTPPVGLMNGLKLSLEMLLGEGLENVFARHHRIAEGVRAAVSAWGLDLCAVSPDVYSDTVSAIRTPEGFNATDIVTLAAEKYDVAFGVGLGEVAGKVFRIGHLGSLTDVMTLSGLATAEMCMADLGLDITLGSGVAAAQQYYRSNSALTQRIAA

SEQ ID NO: 423 - protein, 396 aa, Leisingera sp. ANG-S3; identical to SEQ ID NO: 386

SEQ ID NO: 424 - protein, 395 aa, Paracoccus saliphilus DSM 18447
MTSQNPVFIPGPTNIPEILRKAVDMPTIDHRSPVFGKILHPALEGVKKVLKTAEGQVFVFPSTGTGGWETAISNTLSPGDKVLATRNGMFSHRWIDMCQRHGLDVEVVDQKWGEGVPADRFEEILTADKAHQIKAVLATHNETATGVKSDIAAVRRAMDAAGHPALLFVDGVSSIGSMDFRMDEWGVDIAVTGSQKGFMLPPGLAIIGFSPKAMAALETAKLPRTFFDIRDMAKGYAANGFPYTPPVGLINGLNLSTQMLLEEGLENVFARHHRIAEGVRKAVAAWGMELCAARPELYSDSVSAIRVPEGFDANKVVGHALEAYGVAFGTGLGDVAGKVFRIGHLGSLTDVMALSGIATAEMVMADLGLPVALGSGVAAAQEHYRQSAAALEKAA

SEQ ID NO: 425 - protein, 392 aa, Rhodovulum sulfidophilum DSM 1374
MHASNPIFLPGPTNLPEPLRRACDIPTMDHRSAAFGPILAAAKDGVARILGLSGGEVALFPATGTGGWEAAVTNALRPGDKVLAARHGMFSRKWIDLCQRHGLEVEIVERPWGEGVPVEEFAAALAADGGHQIRAVLVTHNETATGVTSDVAAVRAAMDATGHPALLMVDGVSSIGSIEFRMDDWGVDLAVAGSQKGFMLPAGLAIIGISAKARQAMETAGLPRCFFDIRDMADGNYPYTPPVGLINGLAVSTGLLLEEGMENVRARHHRIAEGVRRAVAAWDMTTCAAAPELCSDTVTAIVTPEGFDAGRIVRHAAEAYGVAFGGGLGEVAGKVFRIGHLGLMSDVMALSGIATAEMAMVDLGLPVRLGSGVAAAQEHYRNSRTAPVQAAA

SEQ ID NO: 426 - protein, 392 aa, Litoreibacter ascidiaceicola DSM 100566
MSFQNPVFIPGPTNMPEAVRQACYMPTIDHRSPTFGKILHPCLEGVRKVLKSKDAKIFIFPSTGTGGWETALSNTLSKGDKVLAARNGMFSHRWIDMCQRHGLDVHVVETPWGEGIPADKYEEILKADTKHEIKVVLATHNETATGVKSDIAAVRKALDAAGHPAMLFVDGVSSIASMDFRFDEWGVDVAITGSQKGFMLPAGLAIIGFSGKAIAAAEKSDLPTTFFDIKDMQKGYDANAFPYTPPVGLMNGLKLSLDMLLEEGLENVFARHHRIAEGVRKAVSAWGLELCAASPDLYSDTVSAIRTPEGFNATDIVTHAADKYDVAFGVGLGEVAGKVFRIGHLGSLTDVMTLSGLATAEMCMVDLGLDVKLGSGVAAAQEYYRTNPVAGK

SEQ ID NO: 427 - protein, 396 aa, Roseovarius marisflavi DSM 29327
MSDQNPVFIPGPTNMPDRLRRAMQVQTQDHRSPAFVETLTPVLEGCKTVFGTANGTIITFPASGTGGWEAAISNTLSPGDKVLVARYGMFSHRWIDMCQRHGLDVQIIECPWGSGAPADKFQEALSADTDHTIKAVLVTHNETATGVKSDIAAVRRAMNTANHPAMMFVDCVSSLGSMDFRMDGWGVDIAVSGSQKGFMLATGMAILAVSPKAIAAMETAKLPRTFFDFRDMMGANAAGGYPYTPPLQLIYGMAESLKMLFEEGLDNVYARHHRLATGVRRAVDAWGLKLVAQSPDLYSDTVSAVFVPEGFDSNALIEHVFATYGVSFGIGMGEMNGRAFRIGHLGSLTDTMVLSGLATIEMAMADLDYPIKLGSGVVAAQEYYRATTKPALAKAA

SEQ ID NO: 428 - protein, 399 aa, Rhodovulum sp. ES.010
MKTGCTHLFIPGPTNIPEPVRQAMNVPMQDMRAPDFGDLTLGLFSDLKRVLRTESGRVFLFPGSGTGAWEAAITNTLNPGDKVLMSRFGQFSHLWVEMAERLGLDVEVIDVPWGGGCPVKEYARRLGADKHGEIKAVFVTHNETATGVTSDVAGVRRALDESFHDALLFVDGVSSIASIDFRMDDWGVDLAVTGSQKGLMLPAGLGVLGVSEKAMEASKTATMRRAYFEFSDMVKLNETGYFPYTPPTQLFHGLRRSLDRIFDEGLDNVIARHHRLAEGVRRGVHAWGMELVAEHPSLWSDTVSAIRVPAEVDARDVIRIGYERYNISFGTGLAQLAGKVFRIGHLGDLNEGMCLTALSLAELSLAAAGARVEFGSGVAAAQDWYAKNSAAPDLKIAAE

SEQ ID NO: 429 - protein, 392 aa, Rhodovulum sp. ES.010
MSSQNPVFIPGPTNIPESIRRACDIPTMDHRSAAFPPLFERAKSGVRQMLKMDEGEVILFPASGTGGWEAAVTNTLSPGDKVLAAQHGMFSLKWIDLCERHGLDVEVVKCPWGEGAPVERFAEILAADTSHEIKAVLVTHNETATGVTSDVAAVRAAMDDAGHPALLMVDGVSSIASIDFRMTEWGVDLAVTGSQKGFMLPVGLAIVGVSPKALTAMETAKLSRCFFDFRDMLKLGTPYTPAVGLINGLGAACDMLLEEGLKNVFARHHRIAEGVRAAVSAWGMRPCADRPALYSDTVTAIVLPEGVDGNALVRHAAEAYHVAFGAGLGEVAGKVFRIGHLGQLTDVMALSGIATAEMAMADMGVAVTLGSGVAAAQDYYRTNKAAPVKAAA

SEQ ID NO: 430 - protein, 396 aa, Ruegeria sp. P4
MSFQNPVFIPGPTNIPESLRKACDMPTIDHRSPLFGQILHPARDGVRKVLKSETAEVFIFPSSGTGGWETALSNTLSAGDTVLAARNGMFSHRWIDMCQRHGLEVQIVETPWGAGLPADRYEEILNADKAHKIKAVLATHNETATGVKSDIAAVRRALDAAGHPALLFVDGVSSIASMDFRMDEWGVDVAVTGSQKGFMLSAGLAIVGFSPKAMEATKTAQLPRTFFDVHDMAKGYANNAYPYTPAVGLMNGLNESCKMLLAEGLENVFARHHRIAEGVRAAVGAWGLELCAASPEVYSDTVSAIRTPEGFNATDIVTHAADKYGVAFGVGLGEVAGKVFRIGHLGSLTDVMALSGIATAEMCMVDLGLDIQLGSGVAAAQDYYRGNAASAQQDAA

SEQ ID NO: 431 - protein, 395 aa, Jannaschia rubra CECT 5088
MNFQNPVFIPGPTNMPEAIRQACYMPTIDHRSPVFGKILNPCLEGVRKVLKSDSARIFIFPSTGTGGWETALTNTLSPGDGILAARNGMFSHRWIDMCQRHGLDVTVVETPWGEGLPAENYEEVLKADKDHRIKAVLATHNETATGVKSDIAAVRRALDAARHPALLFVDGVSSIGSMDFRFDDWGVDVAVTGSQKGFMLPAGLAIVGFSDKAMKATETAKLPRTFFDVRDMGKGYDNNAFPYTPPVGLMNGLKLSLDMLLDEGLENVFARHHRIAEGVRRAVRAWGLELCAVSPDLYSDTVSAIRTPEGFNATDIVTVAARDYDMAFGVGLGEVAGKVFRIGHLGSLTDAMMLSGLGVAEMVMVDLGLDVKLGSGVSAAQEFYRHGGTARKAAA

SEQ ID NO: 432 - protein, 396 aa, Ruegeria atlantica CECT 4292
MSNQNPVFIPGPTNIPDRLRLAMQVQTQDHRAPDFVETFAPVLEDTKKVFGTTTGQIVTFPSSGTGGWEAAITNTLSPGDKVLVARYGVFSHRWVDLCERHGLDVQIVECPWGTGAPADQFQAALANDTAHEIRAVLVTHNETATGVRSDIAAVRQAMDSENHPSMLFVDCVSSLASMPFDFDAWGVDIAVSGSQKGFMLATGMAILCVSPKAQDAMKSAKLPRTFFDFDDMMAANASGGFPYTPPLQLIYGMRESLKMLFEEGLENVYARHFRLAEGVRRAVDAWGLKLVAQSPDLYSDTVSAIYVPNGYDSNTLTDHAFNAYGVSFGIGLGQLNGKTFRIGHLGSLTDVMVLSGLGTIEMAMADLNYPITLGSGVAAAQDFYRTGPSDRAQAAA

SEQ ID NO: 433 - protein, 396 aa, Rhizobium sp. N324
MYGQNPVFIPGPTNMPEILRKAADMPTMDHRSSMFGEILHPALAGVKQVLKTETASVFIFPATGSGGWETAITNTLSPGDRVLAGRHGMFSHKWIDMCRRYQLKVDAIESSWHDGVPLAQYEELLNGDKAHEIKAVLVTHNETATGVKSDVAAVRRLLNAANHPALLLVDGVSSIASMDFRMDEWGVDVAVTGSQKGFMLPVGLAITAFSAKAMAALETAKFPRAFFDVRDMAKGYSTNGYPYTPSVGLLNGLKVSTELLLQEGLENVFARHRRIASGVRAAVRAWRLELYAAREELYSDTVTAVQTPAGFDASRFVTHAATKYDVAFGAGLGDVAGKVFRIGHVGSMTDVMALSGIATAEMVMVDLGLNIKLGSGVAAAQAIYRNSQSSAFYMVA

SEQ ID NO: 434 - protein, 396 aa, Rhizobium sp. N941; identical to SEQ ID NO: 433

SEQ ID NO: 435 - protein, 396 aa, Sinorhizobium americanum CFNEI 73
MYLQNPVFIPGPTNMPEVLRKASDMPTIDHRSPLFGEILRPALAGVKKIVKSDAASIFVFPATGTGGWETAITNTLSPGDRVLVARYGMFSHRWIDMCQRHGLDVSVIETSWGSGAPVDRYEEMLTADKAHQIKAVLVTHNETATGVKSDIAAVRRALDATRHPAMLFVDGVSSIASMEFRMDDWGVDVAVTGSQKGFMLPAGLAITAFSPKALAALETAKLPRTFFDIRDMSKSYENNAYPYTPAVGLLNGLKVSTEMLLAEGLENVFARHKRIATGVRAAVRAWGLELCARSEDLYSDTVSTIRTPDGFDATSVVTHAAKKYDVAFGVGLGEVAGKVFRIGHLGSLTDVMALSGIATAEMVMADLGLAIKLGSGVAAAQEYYRSNQVSAGRGAA

SEQ ID NO: 436 - protein, 395 aa, Sinorhizobium americanum CFNEI 73
MSGYNHLFIPGPTNIPERVRQAMNLPMEDMRSPRYPELTLPLFADIKEVFKNKTGRVFIYPSSGTGAWEAAMTNVLSPGDRVLMSRFGQFSHLWVDMAERLGFEVDCLDREWGTGVPVELYAERLAADKAHEIKAVFVTHNETATGVTSDVAAVRAALDACGHPALLFVDGVSSIGSIDFRQDEWGVDCAVSGSQKGFMMPAGLGFLSVSQKALEAARTARHMRCYFSFEDMIKTNDTGYFPYTPPTQLLRGLRAALDLIFEEGLETIFARHHHLANGVRAAVSAWGLKLCATEPKWHSDTVSAIRLPEGIDGVEVIRHAYQTYNTSLGSGLSKVAGKVFRIGHLGSLNEVMVLGALSAAELTLLDCGVKIEPGAGVGAAISQFRSAAVSSAKAA

SEQ ID NO: 437 - protein, 398 aa, Puniceibacterium sediminis DSM 29052
MAGYNHLYIPGPTNVPEEVRMAMNVCMQDMRAPDFPNFTKPLFAKVQKVFKNTTGRVFLYPSSGTGAWEAAIQNTLSPGDKVLMSRFGQFSHLWVDMAQRLGLDVEVIECEWGEGVPVEKYATRLKADPGHEIKAVFATHNETATGVSSDIKGVRAALDAANHPALLMVDGVSSIGSIEFDQDAWGVDCAVSGSQKGFMLPAGIGILSVSKWALEAHKHAEYPRTFFSFEDMIATNDQGYFPYTPATQLLRGLDVACDMIHAEGLENIWARHHRLASGVRAAVDAWGLKLCAKEAKWHSNTVSAILVPDGVDARDVIATGYSKYNTSFGTGLSKVMGRVFRIGHLGWLNEGMVSTALSVAEMSMIDVGMNIKAGSGVGAAIDYFTSTAAKSGKAIAAE

SEQ ID NO: 438 - protein, 396 aa, Puniceibacterium sediminis DSM 29052
MSIQNPVFIPGPTNIPESVRKACDMPTIDHRSPLFATILHPAIDGCRKVLKTTEGELFIFPASGTGGWEASLTNTLNPGDTILAARNGMFSHKWIDMCHRFGLNVIQVDVPWGEGLPVPKFEEILRADPDGRIKAVLATHNETATGVVSDVAGLRRAMDAAGHGALLMVDGVSSIGSMNFEFDNWGVDVAVTGSQKGFMLPAGLAITCFSPKAIAASKTATLPRTFWSIDDMRNGYAANAYPYTPSVGLLNGLKHTTEMLLAEGLDNVFARHARIADGVRAAVRAWGMTPCAVSPDLYSNTVTAICTPEGFNASTIVERASLQYGMAFGTGLGDVAGKVFRIGHLGMLTDAMALSGIATAEMVMVDLGLPVTLGSGVAAAQEIYRKGGKIQKEQAA

SEQ ID NO: 439 - protein, 396 aa, Hyphomicrobium sulfonivorans WDL6
MSVQNPIFIPGPTNIPEVLRKAVDMPTIDHRSSLFGQILRPAIDGAKKVFKTTDGQLFIFPSTGTGGWEIAITNVLSPGDKVLATCNGMFSQRWIDMCRRHQLDVTMIQQAWGDGISAERVEKILAADKHHRISVVLATHNETATGVKSDIAALRRSLNATKHPALLFVDGVSSIGSMDFRMDEWGVDVAVSGSQKGFMLPPGLAIVGFSARALEATENARLPRTFFDIRDMAKSNALNGFPYTPPVGLLNGLKLSTEMLLEEGLDNVFARHHRIAEGVRAAISAWGMQLCALRPELYSDTVSAICVPDGFDANKIVARALNAYGVAFGTGIGAVAGKVFRIGHLGSLTEAMALSGIATAEMTMVDLGLPITLGAGTAAAQQHFRLSIESTQRKAA

SEQ ID NO: 440 - protein, 397 aa, Marivita geojedonensis DSM 29432
MSFQNPVFIPGPTNIPESLRKACDMPTIDHRSPLFGQILHPARKAVQQILKSTSAEVFIFPASGTGGWETALTNTLSAGDTVLVARNGMFSHRWIDMCERFGLDVIIVDVAWGNGIPADRYEEILTKDTAHRIKAVLATHNETATGVKSDIAAVRRAMDAAKHPALLMVDGVSSIASMDFRFDEWGVDVAVTGSQKGFMLPAGLAIVGFSQKAMEATKTAGLFRTFFDVHDMMKGYANNAYPYTPAVGLMNGLNEACRMLQAEGLENVFARHIRIAEGVRAAVDAWGLKLCAETPDVYSDTVSAIRTPEGFNASDIVSHAATTYGVAFGTGLGDVAGKVFRIGHLGSLTDVMALSGIATAEMCMVDLGLDIKLGSGVAAAQDYYRQGSNIAQKVAAE

SEQ ID NO: 441 - protein, 392 aa, Marinobacterium mangrovicola DSM 27697
MSDQNPVFIPGPTNIPDRLRNAMHIQTRDHRAPDFVETFAPVLEDCKRVFGTETGQVITFPASGTGGWEASICNTLSAGDTVLVARYGMFSHRWIDLCQRHNLEVQVIDCEWGSGAPADLFEQALKADTDKTIKAVLVTHNETATGVKSDIAAVRRAMDAASHPAMLFVDCVSSLASMPFHMDDWGVDIAVSGSQKGFMLATGMAILGVSQKALAAMETATLPRTFFDFRDMMAANASGGFPYTPPLQLIYGMRESLKMLLEEGLDNVYARHFRLAEGVRKAVEAWGMKLCAQSPELYSDTVSAIYVPEGFDSNELTEHAFNAYGVSFGIGLGEMNGKAFRIGHLGSLTDVMVLSGLATIEMAMADLNYPFELGSGVRAAQEYYRATAAANQ

SEQ ID NO: 442 - protein, 396 aa, Stappia aggregata IAM 12614
MSFQNPVFIPGPTNMPEALRRACDMPTLDHRSPLFGQILQPALAGVKKVLKTETAEVFLFPSTGTGGWETAITNCLSPGDKILAARNGMFSHRWIDMCQRHGLKVEVVEAPWGTGLPADRYEEILTADTSHEIKAVLATHNETATGVKSDIAAVRRALNAAKHPALFFVDGVSSIASMDFRMDEWGVDAAVTGSQKGFMLPPGLAIIALSPKAQAAVESARLPRTFFDVRDMMKAYASNAYPYTPAVGLMNGLKQSCDMLLAEGLENVFARHHRIAEGVRAAVRAWGLELCARSPDIYSDSVSAIRTPEGFNATGIVTHAAAKYGVAFGVGLGEVAGKVFRIGHLGSLTDVMMLSGLATAEMVMADLGLDIKLGSGVAAAQEVYRSDSAIASKEAA

SEQ ID NO: 443 - protein, 406 aa, Sagittula stellata E-37
MLSPTGGDRMSNQNPVFIPGPTNMPDRLRLKMLAQTMDHRAPDFAGVFRPMLEDTKKVFGTAEGEVIAFPGSGTGGWEAAVANTLSPGDKVLVARYGLFSHKWIDLCQRFGLDMQVIDVPWGEGAPAARFEEILSADTGHEIKVVLVTHNETATGVLSDVGAVRRAMDAARHPAMMFVDCVSSLASVPFHFDAWGVDVAVSGSQKGFMLPAGMAITCVSKKAMAATEHARLPRCYFDFRDMLASNAKGGFPYTPPLQLIYGMREALDMLFEEGLEAVYARHVRLAEGVRRAVSAWGMELVAASPDLYSPTVSAVRVPEGFDSNALTEHAYIAYGVSFGVGLGQLDGKAFRIGHLGMLTDVMVLSGLATVEMAMADLGYPVRLGSGVAAAQEHYRSSRGAGALRDAA

SEQ ID NO: 444 - protein, 401 aa, Roseobacter sp. CCS2
MEDWMMSFQNPVFIPGPTNMPEAIRKACDMPTIDHRSPLFGQILHPARAGVQEILKSETAEIFIFPSTGTGGWETALTNTLSAGDTILAARNGMFSHRWIDMCLRHELNVKIVETPWGHGLPADRYAEILKADTEHKIKAVLATHNETATGVKSDIAAVRKALDAANHPAMLFVDGVSSIGSMDFRFDEWGVDVAVTGSQKGFMLPAGLAIVGFSQKALDASKTAGLPRTFFDIADMSKGYAANAYPYTPAVGLMNGLLLATETLLKEGLDNVFARHTRIASGVRAAVDGWGLELCAATPDIYSDTVSAIKTPEGFNATDIVTHAADKYGVAFGVGLGEVAGKVFRIGHLGSMTDVMALSGIATAEMCMVDLGLDIKLGSGVAAAQEYYRTSTGLSLEDAA

SEQ ID NO: 445 - protein, 397 aa, Roseobacter sp. AzwK-3b
MSFQNPVFIPGPTNMPEELRKAVDMPTLDHRSPLFADILHPALEGVKAVLKSQTAEVFVFPGTGTGGWETAISNTLSAGDAVLAARNGMFSHRWIDLCQRHGLDVQVIEAGWGAGLPADRYEEVLAADTGHRIKAVLATHNETATGVVSDIAAIRRAMDAASHPALLLVDGVSSIGSMDFRMDEWGVDIAVTGSQKGFMLPAGLAIVAFSPRAMQAVEGATLHRTYFDIRDMARGYAAGAYPYTPAVGLLNGLKMATGMLLDEGLDNVFARHHRIAGGVRRAVHAWGLELCADSPDLWSDTVSAIRMPEGVDANRFVAHAVERYGVAFGTGLGELAGKAFRIGHLGRMTDVMALSGIATAEMVMADLGMDIALGSGVAAAQAHYRLDPATTTRKEAA

SEQ ID NO: 446 - protein, 396 aa, Rhodobacteraceae bacterium KLH11
  MISC_FEATURE (1)..(396): scf_1108856220445 genomic scaffold
MSNQNPVFIPGPTNIPDRLRLAMQVQTQDHRAPDFVETFAPVLEDTKKVFKTTDGQIVTFPASGTGGWEAAITNTLSPGDKVLVARYGVFSHRWIDLCERHGLDVQIVECPWGTGAPADKFEEILAADKAHQIKAVLVTHNETATGVRSDIGAVRRAMDAASHPAMMFVDCVSSLASMPFEFDQWGVDIAVSGSQKGFMLATGMAILCVSPKALAAMESAKLPRTFFDFRDMMAANASGGFPYTPPLQLIYGMGESLKMLFEEGLDNVYARHTRLAEGVRRATRAWGMELVAQSPDLYSDTVSAVYVPEGFDSNELTDHAFNAYGVSFGIGLGQMDGKAFRIGHLGSLTDVMVLSGLATIEMAMADLSYPVELGSGVAAAQEFYRTGSSKHTKAAA

SEQ ID NO: 447 - protein, 396 aa, Silicibacter sp. TrichCH4B
  MISC_FEATURE (1)..(396): genomic scaffold scf_1113354613205
MSFQNPVFIPGPTNIPESLRKACDMPTIDHRSPLFGQILHPARDGVRKVLKSETAEVFIFPSSGTGGWETALSNTLSAGDNVLAARNGMFSHRWIDMCQRHGLEVQIVETPWGAGLPADRYEEILSADKAHKIKAVLATHNETATGVKSDIAAVRRALDAAGHPALLFVDGVSSIASMDFRMDEWGVDVAVTGSQKGFMLSAGLAIVGFSPKAMEATKSAQLPRTFFDVHDMAKGYANNAYPYTPAVGMMNGLNESCKMLLAEGLENVFARHHRIAEGVRAAVGAWGLELCAATPEVYSDTVSAIRTPEGFNATDIVTHAADKYGVAFGVGLGEVAGKVFRIGHLGSLTDVMALSGIATAEMCMVDLGLDIQLGSGVAAAQEYYRGNAVSAQQDAA

SEQ ID NO: 448 - protein, 395 aa, Pelagibaca bermudensis HTCC2601
  MISC_FEATURE (1)..(395): 1100011001308
MSFQNPVFIPGPTNIPERLRKACDMPTIDHRSPLFGQILHPAREGVRKVLKSDSAEVFIFPSTGTGGWETALSNCLSAGDTVLAARNGMFSHRWIDMCQRHGLNVEIVETPWGHGLPADRYEEILTADTGHRIKAVLATHNETATGVKSDIAAVRRALDAAGHPALLFVDGVSSIASMDFRFDEWGVDVAVAGSQKGFMLPPGLAITGFSAKAMEATKTATLPRTFFDVADMAKGYANNAYPYTPAVGLLNGLNEACGMLLAEGLESVFARHHRIAEGVRAAVGAWGLELCAVSPDVYSDTVSAIRTPEGFNATRIVEHAASAYGVAFGTGLGEVAGKVFRIGHLGSLTDVMALSGIATAEMVMADLGLDIRLGSGVAAAQDYYRANRAPLRAAA

SEQ ID NO: 449 - protein, 396 aa, Paracoccus sp. J39 ICCT; identical to SEQ ID NO: 409

SEQ ID NO: 450 - protein, 396 aa, Paracoccus sp. J55
MTSQNPIFIPGPTNIPEEMRKAVDMPTIDHRSPVFGRMLHPALEGVKKVLKTETAQVFLFPSTGTGGWETAITNTLSPGDKVLAARNGMFSHRWIDMCQRHGLDVTYVETPWGEGIPADRFEEILTADKGHEIRVVLATHNETATGVKSDIAAVRRALDAAKHPALLFVDGVSSIGSMDFRMDEWGVDIAVTGSQKGFMLPPGLAIVGFSPKAMEAVESARLPRTFFDIRDMATGYARNGYPYTPPVGLINGLNLSCERLLAEGLENVFARHRRIAGGVRAAVEAWGLKLCAVRPELYSDSVSAIRVPEGFDANLIVSHALETYDMAFGTGLGQVAGKVFRIGHLGSLTDAMALSGIATAEMVMADLGLPIRLGSGVAAAQEHYRQTTAAAQKKAA

SEQ ID NO: 451 - protein, 396 aa, Rhodovibrio salinarum DSM 9154
MSQQNPVFIPGPTNVPDRLRRVMDMQTLDHRAPDFADTFQPVLAGVKRILKASSAQVMLFPASGTGGWEAAITNTLSPGDKVLAARYGMFSHRWIDLCQHHGLDVQVIDVEWGEGAPVEQYAEALQADSNHEIKAVLACHNETATGVVSDIAGLRNALDDTGHPALLFIDGVSSIASMDFRFDEWGVDIAITGSQKGFMLYTGMAIVAVSEKALQAMESARLPRCFLDFRDMLNANAQGSFPYTPPLQLIFGLSESIKMLEEEGLENVFARHHRLAEGVRQAAQAWGLPLCAKRPELYSDSVTAIHVPDGFDATALINHAYAAYGVSYGVGLGEVAGKVFRIGHLGSLTDVMALTGISTIEMAMHELGYPIQLGAGTAAAQAYYSKTRGELRAMAA

SEQ ID NO: 452 - protein, 396 aa, Rubellimicrobium mesophilum DSM 19309
  MISC_FEATURE (1)..(396): scaffold version
VSAQNPVFIPGPTNMPEALRKACDMPTIDHRSAVFGEILAPCLAGVRRVLKSERAQVFLFPSTGTGGWETAISNTLSPGDKVLAARHGMFSHRWIDLCQRHGLSVQVVEAPWGAGLPADRYAEILAADTAHEIKAVLATHNETATGVRSDIAAVRRTLDAAGHPALLLVDGVSSIASMDFRMDQWGVDVAVTGSQKGFMLPAGLAIVAFSDKAWRATETAKLPRTFFDVRDMGQSYARNGFPYTPPVGLMNGLRLSTEMLLKEGLENVFARHRRIADGVRAAVAAWEMPLCAEGPELWSDTVSAIRTPEGFDATKIVTHAAAKYGVAFGVGLGEVAGKVFRIGHLGSLTDVMMLSGLATAEMAMADLGLPVRLGSGVAAAQEVYRASEAKLEKAAA

SEQ ID NO: 453 - protein, 398 aa, Maritimibacter sp. HL-12
MSLQNPVFIPGPTNIPEALRKACDMPTIDHRSSVFPQILQPALAGVKRVLKTEAGEAIVFPGTGTGGWEAAISNTLSPGDKVLAANFGMFSAKWIDMCRRHGLEVQVVEAPWGAALPVATFAEILAADTGHEIRAVLATHNETATGVRSDIAGLRAAMNAADHPALLFVDGVSSIASMDFRMDEWGIDVAITGSQKGFMLPAGLAIVAVSRKAVAAMERATLPRFYFDFRDMLAMNPASGYPYTPVVGLLNGLKASIEMLEAEGLDAVFARHAHIADGVRVAVGAWGLRFCAIAPDARSDTVTAIVLPDGIDGNAFVAHAETRYGTSFGAGLGAVAGKVFRIGHLGQLSETQALAGIATAEMVLADLGVDIALGSGVAAAQGVYRSAVKGHGSARAAA

SEQ ID NO: 454 - protein, 396 aa, Methylobacterium sp. L2-4
MFAQNPVFIPGPTNMPEVLRRAADMPTLDHRSPLFAQILHPALAGVKTVLKSQDAEVFVFPSTATGGWETALSNTLSAGDAVLAARHGMFSHRWIDMTRRHGLDVRVIEAPWGEGLPADRFAEALAADTAHRIRAVLVTHNETATGVRSDVAAVRRALDASGHPALLLVDGVSSIASMDFRMDEWGVDVAVTGSQKGFMLPAGLAIVAFSPRAMAATATATLPRTYFDVRDMAKGYPNGAYPYTPAVGLLNGLKLSTELLLAEGLDNVFARHRRIADGIRAAVAAWGLELCAARPDLYSDTVSAIRTPEGFDATRIVTHAARHYDVAFGVGLGEVAGKVFRIGHLGSLTDVMALSGIAAAEMAMADLGLRIELGSGVAAAQAVYRRAPAAGLRAAA

SEQ ID NO: 455 - protein, 399 aa, Ensifer fredii GR64
MHMQNPVFIPGPTNMPEVLRKASDMPTIDHRSSLFGEILRPALAGVQKVVKSEAASIFVFPATGTGGWETAITNTLSPGDRVLAARNGMFSHRWIDMCQRHGLNVEIILASWGSGAPAERYEEILVADKAHEIKAVLVTHNETATGVRSDIAAVRRAIDAARHPAMLFVDGVSSIASLDFRMDEWGVDVAVTGSQKGFMLPAGLAITAFSPKALAALETAKLPRTFFDVRDMAKSYAGNAYPYTPAVGLLNGLKVSTEILLEERLENVFARHKRIASGVRAAVGAWGLELCATSEDLYSDTVSAIRTPEGFDATSVVTHAAKKYDVAFGVGLGEVAGKVFRIGHLGSLTDVMALSGIATAEMVMADLGLPIKLGSGVAAAQQYYRENDVSAVRKSAEEI

SEQ ID NO: 456 - protein, 396 aa, Ensifer fredii GR64
MSGYNHLFIPGPTNIPEQVRQAMNLPMEDMRSPRYPELTLPLFADVKKVFKNRNGRVFIYPSSGTGAWEAAMTNVLSPGDKVLMSRFGQFSHLWVDMAERLGFEVDCLDREWGTGVPVKLYAERLAADKAHKIKAVFVTHNETATGVTSDVAAVRAALDACGHPALLFVDGVSSIGSIDFRQDEWGVDCAVSGSQKGFMLPAGLGFLSVSQKALDAAKTARHMRCYFSFEDMIKTNDTGYFPYTPPTQLLRGLRAALDLIFEEGLENIFARHHHLADGVRAAVSAWGLKLCATEPKWHSDTVSAIRLPEGVDGVEVIRHAYRTYNTSLGSGLSKVAGKVFRIGHLGSLNEVMVLGALSAAELTLLDCGVKIEPGVGVGAAIRQFRSAAATATAEAA

SEQ ID NO: 457 - protein, 395 aa, Ponticoccus litoralis DSM 18986
MSFQNPVFIPGPTNIPERLRKACDMPTIDHRSPLFGQILHPAREGVRKVLKSESAEVFIFPSTGTGGWETALSNCLSAGDTVLAARNGMFSHRWIDMCQRHGLDVEIVETPWGQGLPADRYEEILTADTGHRIKAVLATHNETATGVKSDIAAVRRALDAAGHPALLFVDGVSSIASMDFRFDEWGVDVAVTGSQKGFMLPPGLAITGFSPKAMAATRTATLPRTFFDVADMAKGYANNAYPYTPAVGLLNGLNEACGMLLSEGLDNVFARHHRIAEGVRAAVKAWGLELCAASPEVYSDTVSAIRTPEGFDATRIVEHAASAYGVAFGTGLGEVAGKVFRIGHLGSLTDVMALSGIATAEMVMADLGLNITLGSGVAAAQDYYRANRTALQAAA

SEQ ID NO: 458 - protein, 396 aa, Rhizobium sp. OK494
MYMQNPVFIPGPTNMPEILRKAADMPTLDHRSPLFGQILRPALAGVKKILKTEAASVYVFPSTGTGGWETAITNTLSPGDRVLAARYGMFSQRWIDMCQRHGLKVDIIEAAWGGGAPAARYEEILAADTAHEIKAVLVTHNETATGVKSDIAAVRRAIDAARHPALLFVDGVSSIASMDFRMDEWLVDIAVTGSQKGFMLPAGLAITAFSPKALAAVETAKLPRTFFDIGDMARSYANNAYPYTPAVGLLNGLKLSTELLLAEGLENVFARHRRIASGIRAAVRAWGLELCAMSEDLYSDTVSAIRTPEGFDATSIVAHAAKTYDVAFGVGLGEVAGKVFRVGHLGSLTDVMALSGIATAEMVMVDLGLDIKLGSGVAAAQDYYRDGRTSKVRAAA

SEQ ID NO: 459 - protein, 388 aa, Planktotalea frisia DSM 23709
VSFQNPVFIPGPTNMPEEIRLATYMPTIDHRSPVFGGILHPCLDGVRRVLKSETAHIFIFPSTGTGGWETTLTNTLSAGDKVLVARNGMFSHRWIDMCERHGLDVQVVDVAWGEGLPVAEYAAILKADKDHTIKAVLATHNETATGVKSDIAGVRGALDAANHPALFFVDGVSSIGSMDFRMDEWGVDVAVTGSQKGFMLPAGLAIVGFSEKARAAVESATLPRTFFDIRDMEKGYAANAFPYTPPVGLMNGLKCAIEMIEAEGLENVFARHTRIATGVRHAVEAWGLELCANAPELYSDSVSAIRTPEGFNATDIVTRADEQYGMAFGVGLGDVAGKVFRIGHLGMLTDAMMLSGLGVAEMVMKDLGLDIKLGSGVGAAQEFYRYGS

SEQ ID NO: 460 - protein, 396 aa, Paracoccus denitrificans DSM 415; identical to SEQ ID NO: 8

SEQ ID NO: 461 - protein, 396 aa, Paracoccus halophilus CGMCC 1.6117
MTSQNPIFIPGPTNIPEEMRKAVDMPTIDHRSPVFGRMLHPALEGVKKVLKSTQAQVFVFPSTGTGGWETAITNTLSPGDKVLAARNGMFSHRWIDMCQRHALDVTFVETPWGEGVPADRFEEILTADKGHEIRVVLATHNETATGVKSDIAAVRRALDAAKHPALLFVDGVSSIGSMDFRMDEWGVDIAVTGSQKGFMLPPGLAIVGFSPKAMEAVETARLPRTFFDIRDMATGYARNGYPYTPPVGLINGLNLSCERLLSEGLENVFARHNRIASGVRAAVGAWGLKLCAVRPELYSDSVSAIRVPEGFDANRIVSHALETYDMAFGTGLGEVAGKVFRIGHLGSLTDAMALSGISVAEMVMADLGLPIKLGSGVAAAQEHYRQTAAAAQKKAA

SEQ ID NO: 462 - protein, 397 aa, Roseovarius tolerans DSM 11457
MSDQNPVFIPGPTNIPDRLRRAMQVQTQDHRSPAFVNTLTPVLAGCLTVFGASEAEIITFPASGTGGWEAAITNTLSPGDTVLVARYGMFSHRWIDMCARHGLNVQIIECPWGSGAPADKFEAALRADTAHKIKAVLVTHNETATGVRSDIGAVRGAMDAAAHPALLMVDCVSSLASMPFEMDAWGVDIAVAGSQKGFMLNTGMAILAVSDKALAAMDSATLPRTFFDFRDMLTTNAKGGYPYTPPLQLIYGMAESLNMLFEEGLENVYARHTRLAEGVRRAVEAWGLRLVAQSPELYSDTVSAIYVPDGFDSNALTEHAFATYGMSFGVGLGEMNGRAFRIGHLGSLTDAMMLSGLATIEMAMADLNYPVKLGSGVIAAQDYYRKTAKPVLTEQAA

SEQ ID NO: 463 - protein, 396 aa, Jannaschia pohangensis DSM 19073
MTSQNPVFIPGPTNMPEAVRLACHMPTMDHRSPAFADILHPCLDGVRRVLKSTEVEVFIFPSTGTGGWETAISNTLSPGDRVLVARNGMFSHRWIDMCQRHGLDVQIVETPWGHGIPVSTYEEILRADTGHAIKAVLATHNETATGVKSDIAGVRRAMEAAGHPALLMVDGVSSIGSMDFRFDEWGVDIAVTGSQKGFMLPAGLAILGFSPRAMAATKTAKLHRTFFDVADMAKGYANNAFPYTPPVGLMNGLKLACDMLLSEGLENVFARHHRMAEGVRRAVDAWDLKLCAASPDVWSDSVSAICTPAGFNATDVVTVAARDYDMAFGVGLGEVAGKVFRIGHLGMLTDAMMLSGLAVAEMAMVDLGLPIKLGSGVAAAQDYYRHGNTQQKAAAE

SEQ ID NO: 464 - protein, 396 aa, Ruegeria sp. 6PALISEP08
MSQQNPVFIPGPTNIPDRLRLAMQVQTQDHRAPDFVETFAPVLEDTKKVFGTDQGQVITFPASGTGGWEAAVTNTLSPGDAVLVARYGMFSHRWIDLCQRHGLDVRIIECPWGSGAPAQKFAEALAADNSHEIKAVLVTHNETATGVRSDIAAVRKAMDASTHPALLFVDCVSSLASMPFEFDDWGVDIAVSGSQKGFMLATGMAILCVSPKALAAMETANLPRTFFDFRDMMNANASGGFPYTPPLQLIYGMRESLKMLFEEGLDNVYARHFRLAEGVRKATSAWGLELVAQSPDLYSDTVSAIFVPDGFDSNALTDHAFNAYGVSFGIGLGEMNGKAFRIGHLGSLTDVMVLSGLATIEMAMADLDYPIELGSGVAAAQAYFRVGHATPMQSAA

SEQ ID NO: 465 - protein, 396 aa, Mesorhizobium sp. F7
MYSQNPVFIPGPTNMPEILRKAADMPTLDHRSPLFGQILRPVLAGVKKILKTEDAEIFLFPSTGTGGWETALTNTLSAGDGVLAARYGMFSHRWIDMCRRHGLDVTVVETSWGSGLPADRYEEILTADKEHRIKAVLATHNETATGVRSDIAAVRRALDAAKHPAMLMVDGVSSIASMDFRMDEWGVDIAVTGSQKGFMLPAGLAIVAFSSKAMDATAAAGLPRTFFDVRDMARNYANGGYPYTPAVGLLNGLKVSTELLLGEGLDNVFARHRRIASGIRAAVKAWGLELCAQSEDLYSDTVSAIRTPEGFNASDIVSHAARKYDIAFGVGLGDVAGKVFRIGHLGSLTDVMALSGVAAAEMAMVDLGLGIKLGSGVAAAQEYYRGADAAQIRVAA

SEQ ID NO: 466 - protein, 393 aa, Neptunomonas antarctica S3-22; identical to SEQ ID NO: 387

SEQ ID NO: 467 - protein, 397 aa, Oceanicola nitratireducens CGMCC 1.7292
MSFQNPVFIPGPTNIPESLRKACDMPTIDHRSPLFGQILHPAREGVRKVLQSESAEIFIFPSTGTGGWETALSNTLSSGDTVLAARNGMFSHRWIDMCQRQRLRVEIVETPWGEGLPADRYAEILAADKHHRIKAVLATHNETATGVRSDIAAVRHALDAAGHPALLFVDGVSSIGSMDFRFDEWGVDCAVTGSQKGFMLPPGLAIVGFSEKAMEATKIAMLPRTFFDVHDMAKGYANNAYPYTPAVGLMNGLNEACRMLLDEGLENVFARHHRIAEGVRCAVRAWGLNLCAASPDIYSDTVSAIRTPKGFNATDIVSHAAQTYGVAFGTGLGEVAGKVFRIGHLGSLTDVMMLSGLATAEMCMADLGLDITLGSGVAAAQEFYRATPALSRKVAAE

SEQ ID NO: 468 - protein, 396 aa, Sinorhizobium fredii CCBAU 25509
MHMQNPVFIPGPTNMPEVLRKASDMPTIDHRSSLFGEILRPALAGVQKVVKSEAASIFVFPATGTGGWETAITNTLSPGDRVLAARNGMFSHRWIDMCQRHGLNVEIILASWGSGAPAERYEEILVADKAHEIKAVLVTHNETATGVRSDVAAVRRAIDAARHPALLFVDGVSSIASMDFRMDEWGVDVAVTGSQKGFMLPAGLAITAFSPKALAALETAKLPRTFFDVRDMAKSYAGNAYPYTPAVGLLNGLKVSTEILLAEGLENVFARHTRIASGVRAAVGAWGLELCATSEDLYSDTVSAIRTPEGFDATSVVTHAAKKYDVAFGVGLGEVAGKVFRIGHLGSLTDVMALSGIATAEMVMADLGLGVRLGSGVAAAQEYYRNNQVSAVQGTA

SEQ ID NO: 469 - protein, 396 aa, Leisingera sp. ANG-M6
MSFQNPVFIPGPTNMPEALRKAVDMPTLDHRSPLFGQILHPALAGVKKVLKSESAEIFVFPSTGTGGWETAITNTLNSGDKILAARNGMFSHRWIDMCQRHGLDVQVVETPWGEGLPADRYEEILTADTSHQIKAVLATHNETATGVKSDIAAVRRALDAAGHPALLFVDGVSSIASMDFRMDEWGVDIAVTGSQKGFMLPPGLAIVGFSPKAMKAAETATLPRTFFDIKDMANGYANSAYPYTPSVGLLNGLNMACGMLLDEGLENVFARHHRIAEGVRAAVRAWGLELCAVSPDVYSDSVSAIRTPDGFDANKFVSLAAEKYGVAFGTGLGEVAGKVFRIGHLGSLTDVMALSGIATAEMVMADLGLNIQLGSGVAAAQDYYRGNTASSTKAAA

SEQ ID NO: 470 - protein, 396 aa, Leisingera sp. ANG-M7
MSFQNPVFIPGPTNMPEALRKAVDMPTLDHRSPLFGQILHPALAGVKKVLKSESAEIFVFPSTGTGGWETAITNTLNAGDKILAARNGMFSHRWIDMCQRHGLDVQIVETPWGEGLPADRYEEILTADTAHEIKAVLATHNETATGVKSDIAAVRRALDAAGHPALLFVDGVSSIASMDFRMDEWGVDIAVTGSQKGFMLPPGLAIVGFSPKAMKAAETATLPRTFFDIKDMANGYANSAYPYTPSVGLLNGLNMACGMLLDEGLENVFARHHRIAEGVRAAVHAWGLELCAVSPDVYSDSVSAIRTPDGFDANKFVSLAAEKYGVAFGTGLGEVAGKVFRIGHLGSLTDVMALSGIATAEMVMADLGLNIQLGSGVAAAQDYYRGNTASSTKAAA

SEQ ID NO: 471 - protein, 396 aa, Loktanella maricola DSM 29128
MSFQNPVFIPGPTNMPEAIRKACDMPTIDHRSPLFGQILHPARAGVQKILKSETAEVFIFPSTGTGGWETALTNTLSAGDTVLAARNGMFSHKWIDMCLRHELNVKIVETPWGHGLPAGRYAEILMADTEHKIKAVLATHNETATGVKSDIAAVRKALDAANHPAMLFVDGVSSIGSMDFRFEEWGVDVAVTGSQKGFMLPAGLAIVGFSQRAMDASKTAGLPRTFFDIADMTKGYEANAYPYTPAVGLMNGLLLATETLLKEGLDNVFARHNRIASGVRAAVDAWGLGLCAATPDVYSDTVSAIKTPEGFNATDIVAHAADKYGVAFGVGLGEVAGQVFRIGHLGSMTDVMALSGIATAEMCMVDLGLDIKLGSGVAAAQEYYRGTTGLSLKDAA

SEQ ID NO: 472 - protein, 396 aa, Loktanella sediminum DSM 28715
MSFQNPVFIPGPTNIPENLRKACDMPTIDHRSPLFGSILHPALDGVRQILKTTKAEVFIFPASGTGGWETAITNTLSAGDTILVARNGMFSHRWIDLCERHGLNVQIVETNWGDGISAEKYAEILSKDKALKIKAVLATHNETATGVKSDIASIGRAVKSVNHPALFMVDGVSSIGSMDFQFDNWGVDVAVTGSQKGFMLPAGLAILGFSERAMAATKSGTLHRTFFDVHDMQAGYANNAYPYTPAVGLMNGLNEACKMLLDEGLDNVFARHTRIASGVRAAVSAWGLELCATAPEFYSDTVSAIRTPAGFNATDIVTHAAETYGVAFGVGLGEVAGKVFRIGHLGSLTDVMALSGIATAEMCMVDLGLDIELGSGVAAAQEVYRAGPAIENRKVA

SEQ ID NO: 473 - protein, 397 aa, Tateyamaria sp. ANG-S1
MSFQNPVFIPGPTNIPESLRKSCDMPTIDHRSPLFGGILNAARDGVRQVLKSETADVFIFPATGTGGWETALTNTLSHGDTVLAARNGMFSHRWIDMCQRLRLDVRVVETPWGHGIPHAQFAEILAADTSHQIKAVLATHNETATGVTSDIAAVRNAMDASDHPALLFVDGVSSIGSIDFQFDGWGVDVAVTGSQKGFMLPAGLAIVGFSAKAMAAQPSAQLPRTFFDIRDMADGYAAGAYPYTPAVGLMNGLSHACTMLLSEGLDTVFARHHRIASGVRAAVSAWGLELCAASPDLYSDTVSAIRTPAGFDASRIVSHAATTYGVAFGGGLGEVAGKVFRIGHLGSLTDVMALSGIATAEMCMADLSLDITLGSGVAAAQQVYRAHGAANVQKDAA

SEQ ID NO: 474 - protein, 396 aa, Labrenzia alexandrii CECT 5112
MSFQNPVFIPGPTNMPDALRKACDMPTLDHRSPLFGEILQPALSGVKKILKSELAEVFIFPSTGTGGWETVITNTLSPGDKILAARNGMFSHRWIDLCQRHGLDVVIVDAPWGTGLPADRYEEILAADTHHEIKAVLATHNETATGVKSDIAAVRRALNNAKHPALLYVDGVSSIASMDFRMDEWGVDAAVTGSQKGFMLPAGLAIVGLSPKAQTAVDQAKLPRTFFDIRDMRKSYAVNAYPYTPAVGLLNGLKHSCDMLLSEGLDNVFARHHRIAEGVRAAVHAWGLQLCAGSRDVYSDTVSAIRTPEGFNATGIVTHAAGKYGVAFGVGLGEVAGKVFRIGHLGSLTDVMTLSGLATAEMVMADLGLSIKLGSGVAAAQDYYRTEEAVSSKEAA

SEQ ID NO: 475 - protein, 397 aa, Roseovarius litoreus DSM 28249
MSFQNPVFIPGPTNMPEELRKAVDMPTLDHRSPLFAAILHPALDGVKAVLKSQTAEVFVFPGTGTGGWETAISNTLSAGDAVLAARNGMFSHRWIDLCQRHGLDVQVIEAGWGAGLPADRYEEILAADTGHRIKAVLATHNETATGVVSDIAAIRRAMDAAGHPALLLVDGVSSIGSMDFRMDDWGVDIAVTGSQKGFMLPAGLAIVAFSPRAMQAVEGATLHRTYFDIRDMARGYAAGGYPYTPAVGLLNGLKMATGMLLDEGLDNVFARHHRIAEGVRRAVHAWGLELCADSPDLWSDTVSAIRMPEGVDANRFVAHAVERYGVAFGTGLGELAGKVFRIGHLGRMTDVMALSGIATAEMVMADLGMDIALGSGVAAAQAHYRLDPATTTRKEAA

SEQ ID NO: 476 - protein, 396 aa, Labrenzia sp. CP4
MSFQNPVFIPGPTNMPEALRRACDMPTLDHRSPLFGQILQPALAGVKKVLKTETAEVFLFPSTGTGGWETAITNCLSPGDNILAARNGMFSHRWIDMCQRHGLKVDVVEAAWGTGLPADRYEEILAADTNHEIKAVLATHNETATGVKSDIAAVRRALNAAKHPALLFVDGVSSIASMDFRMDEWGVDAAVTGSQKGFMLPPGLAIIALSPKAQAAVESARLPRTFFDVRDMMKAYANNAYPYTPAVGLMNGLKQSCDMLLAEGLDNVFARHHRIAEGVRAAVRAWGLELCAQTPDVYSDSVSAIRTPGGFNATGIVTHAAAKYGVAFGVGLGEVAGKVFRIGHLGSLTDVMMLSGLATAEMVMADLGLDIQLGSGVAAAQEVYRSDSAIASKEAA

SEQ ID NO: 477 - protein, 396 aa, Rhizobium sp. N541; identical to SEQ ID NO: 433

SEQ ID NO: 478 - protein, 396 aa, Paracoccus sp. MKU1
MTSQNPIFIPGPTNIPEEMRKAVDMPTIDHRSPVFGRMLHPALEGVKKVLKTTQAQIFLFPSTGTGGWETAITNTLSPGDKVLAARNGMFSHRWIDMCQRHGLDVTFVETPWGEGIPADRFEEILTADKGHEIRAVLATHNETATGVKSDIAAVRRALDNAKHPAMLFVDGVSSIGSMDFRMDEWGVDIAVTGSQKGFMLPPGLAIVGFSPKAMEAVESARLPRTFFDIRDMATGYARNGYPYTPPVGLINGLNASCERILAEGLENVFARHHRIASGVRAAVEAWGLKLCAARPELYSDSVSAIRVPEGFDANLIVSHALETYDMAFGTGLGQVAGKVFRIGHLGSLTDAMALSGIATAEMVMADLGLPIRLGSGVAAAQEHYRQTTAAAQKKAA

SEQ ID NO: 479 - protein, 396 aa, Pseudoruegeria marinistellae SF-16
MSFQNPVFIPGPTNIPESLRKACDMPTIDHRSPLFGQILHPAREGVRKVLKSDSAEVFIFPSTGTGGWETALTNTLSPGDKVLAARNGMFSHRWIDMCQRHGLDVQIVEAQWGAGLPADRYEEILTADKGHEIKAVLATHNETATGVKSDIAAVRRALDAAGHPALLFVDGVSSIASMDFRFDAWGVDVAVTGSQKGFMLTAGLAITGFSEKAMAATGSATLPRTFFDIRDMETGYANNAYPYTPAVGLLNGLNEACRMLLDEGLENVFARHHRIAEGVRAAVRAWGLELCAISPEVYSDTVSAIRTPDGFNATDIVTHAANTYGVAFGVGLGEVAGKVFRIGHLGSLTDVMTLSGIATAEMCMADLGLDITLGSGVAAAQEYYRAHSALPQKDAA

SEQ ID NO: 480 - protein, 396 aa, Ruegeria conchae DSM 29317
MSNQNPVFIPGPTNIPDRLRLAMQVQTQDHRAPDFVETFAPVLEDTKKVFGTTEGQIITFPASGTGGWEAAITNTLSPGDKVLVARYGVFSHRWIDLCERHGLDVQIVECTWGTGAPADRFEAILSADKAHDIKAVLVTHNETATGVRSDIRAVRHAMNAANHPAMMFVDCVSSLASMPFEFDQWGVDIAVSGSQKGFMLATGMAILCVSPKALAAMETAKLPRTFFDFRDMMAANASGGFPYTPPLQLIYGMRESLKMLFEEGLDNVYARHTRLAEGVRRAANAWGLKLVAQTPDLCSDTVSAIYVPEGFDSNELTDHAFNTYGVSFGIGLGELNGKAFRIGHLGSLTDVMVLSGLATIEMAMADLNYPIELGGGVAAAQEFYRAGTSGHAKAAA

SEQ ID NO: 481 - protein, 396 aa, Labrenzia sp. C1B10
MSFQNPVFIPGPTNMPEALRRACDMPTLDHRSPLFGQILQPALAGVKKVLKTETAEVFLFPSTGTGGWETAITNCLSPGDKILAARNGMFSHRWIDMCQRHGLKVEVVEAAWGTGLPADRYEEILAADTNHVIKAVLATHNETATGVKSDIAAVRRALNAAKHPALLFVDGVSSIASMDFRMDEWGVDAAVTGSQKGFMLPPGLAIIALSPKAQAAVESARLPRTFFDVRDMMKAYANNAYPYTPAVGLMNGLKQSCDMLLAEGLDNVFARHHRIAEGVRAAVRAWGLELCAQTLDVYSDSVSAIRTPEGFNATGIVTHAAAKYGVAFGVGLGEVAGKVFRIGHLGSLTDVMMLSGLATAEMVMADLGLDIKLGSGVAAAQEVYRSDSAIASKEAA

SEQ ID NO: 482 - protein, 396 aa, Methylobacterium radiotolerans NDB3P7; identical to SEQ ID NO: 401

SEQ ID NO: 483 - protein, 391 aa, Psychrobacter arcticus 273-4
MSLQNPIFIPGPTNIPDRLRRAMNVPTQDHRAPDFSDTFLPVLADCKKVFGTQDSEIILFTSSGTGGWEAAISNTLSPGDKVLIARYGMFSHRWIDMCQRHGLDVQVIECPWGTGAPADQFQAILSEDTAHEIKAVMVTHNETATGVLSDIGAVRKAIDSSNHPALLFVDGVSSIASVPFEMDEWGVDVAVAGSQKGFMLATGMAILGVSQKALSHMDEAKLPRTYFDFRDMLKANANGGFPYTPPLNLIYGLRESLEMLFDEGLENVYARHYRLAEGVRQAVSAWGMILCAKTPDLYSNTVSAIFVPEGFNSNKLTDHAFNKYGISFGIGLGEMNGKAFRIGHLGSLTEVMVLAGLAAIEMAMVDLDYPIKLGQGVAAAQEYYRNTATTK

SEQ ID NO: 484 - protein, 469 aa, Roseovarius sp. 217
MAVIPLVAVVVGDCMQNKKYFHVILLIRYEKIKIKQYHMFDYFINIMKIPFKKIAKADFLRHSMLISEEDGAMSDQNPVFIPGPTNIPDRLRRAMQVQTQDHRSPAFVNTLNPVLKGCKTVFSTTKGEIITFPASGTGGWEAAITNTLSPGDKVLVARYGMFSHRWIDMCQRHGLDVQIIECPWGSGAPADRFQEALTADKGHSIKAVLVTHNETATGVRSDIAAVRGAMNSAKHPALLMVDCVSSLGSMPFEMDDWGVDIAVSGSQKGFMLNTGMAILAVSPKALAMMETAKLPRTFFDFRDMMGANAKGGFPYTPPLQLIYGMAESLNMLFEEGLENVYARHARIAEGVRRAVDAWGLKLVAQTPDLYSDTVSAVFVPEGFDSNRLTERVFGTYGMSFGVGLGEMNGRAFRIGHLGSLTESMMLSGLATLEMAMVDLNYPVKLGSGVIAAQEYYRSTAKPVLAEKAA

SEQ ID NO: 485 - protein, 389 aa, Marinobacter sp. ELB17
MSDQNPIFIPGPTNIPDRLRFAMNVQSSDHRSPGFVETLSPLLQDCKKVFNTQSGEVILFPASGTGGWEAAICNTLSPGDKVLIARYGMFSRRWIEMCQRHGLDVQIIECPWGSGAPANEFKRALSADTQHKIKAVLVVHNETATGVTSDIDAVRQAMDSCFHPALLLVDCVSSLASMPFEMDNWGVDIAVSGSQKGFMLITGMAILAVSQKALVAMETAKLSCAFFDFRAMMTANAQGGFPYTPPLQLIYGLKESLKMLFEEGLDNVYARHFRLAEGVRQAAHAWGMALCAQSPDLYSNTVTAIYVPEGLNSNELTDHTFAKYGVSFGIGLGEMHGKAFRIGHLGSLTDSMVLSGLATIEMAMADLDYPIELGTGVRAAQNHFRATIA

SEQ ID NO: 486 - protein, 396 aa, Rhizobium leguminosarum bv. trifolii WSM597
MYTQNPVFIPGPTNMPEVLRRATDLPTIDHRSAAFADILQPALAGVRKVVKSETAEVVVFPATGSGGWEATITNLLSPGDRVLAARCGVFSHRWIDMCQRHGLQVDTVHASWKQPLPLAEYEKRLLADKEHAIKAVLVTHNETGTGVRSDVGAVRRLLDEARHPALLLVDGVSSIASMDFRMDEWKVDAAITGSQKGFMLPVGLAILALSAKAMQATQSATLHRGFFDIREMAKTYPSSGYPYTPSIGLLNGLKVSTELLLGEGLDNVFKRHARIASGVRAAVSAWGLSLYAQEKSSFSDTVSAIETPEGFDATSIVTHAAQKYGVAFGAGLADVAGRVFRIGHLGSMSDVMALSGIATAEMAMVDLGLPIRLGSGVAAAQEIYRNTTASPVRNAA

SEQ ID NO: 487 - protein, 396 aa, Artificial Sequence
  synthetic sequence
  MISC_FEATURE (1)..(396): pMeth_A285
MSFQNPVFIPGPTNMPEALRKAVDMPTLDHRSPLFGQILHPALAGVKKILKSETAEIFVFPSTGTGGWETAITNTLNAGDKILAARNGMFSHRWIDMCQRHGLDVQVVETPWGAGIPADRYEEILTADKGHEIKVVLATHNETATGVKSDIAAIRRALDAAGHPALLFVDGVSSIASMDFRMDEWGVDIAVTGSQKGFMLPPGLAIVGFSPKAMKAADTATLPRTFFDIKDMAAGYANSAYPYTPSIGLLNGLNMACGMLLDEGLENVFARHHRIAEGVRAAVRAWGLELCAVSPDIYSDSVSAIRTPDGFDANKFVSLAAEKYGVAFGTGLGEVAGKVFRIGHLGSLTDVMALSGIATAEMVMADLGLNIQLGSGVAAAQDYYRGNSANSAKAAA

SEQ ID NO: 488 - protein, 396 aa, Roseobacter litoralis Och 149
MSDQNPVFIPGPTNIPDRLRAAMHVQTRDHRAPDFVETFAPVLEDTKKVFGTTSGRVITFPASGTGGWEAALCNTLSPGDKVLVARYGMFSHRWIDMCERHGLDVQLIECPWGTGAPADKFEAALSADKSHSIKAVLVTHNETATGVKSDVAAVRGAMDAAAHPALLFVDCVSSLASMPFEMDSWGVDIAVSGSQKGFMLATGMAILGVSDKALAAMEAATLPRTFFDFKDMMGANASGGFPYTPPLQLIYGMRESLKMLLEEGLDNVYARHTRLAEGVRRAVGAWGLELVAQTPDLYSDTVSAIYVPSGFDSNALTDQAFNQYGVSFGVGLGEMNGKAFRIGHLGSLTDVMVLSGLATIEMAMADLDYPIELGSGVAAAQEHFRSKTGAAIKSAA

SEQ ID NO: 489 - protein, 388 aa, Octadecabacter antarcticus 307
MSFQNPVFIPGPTNMPEAIRQACYMPTIDHRSPMFGKILHPVLDGVRRVLKSKTAKIFIFPSTGTGGWETALSNCLNAGDKVLAARNGMFSHRWIDMCLRHGLDVQVVETPWGHGLPAAEYEDILKADKNHDIKVVLATHNETATGVKSDIAAVRKALEAANHPAMLFVDGVSSIGSMDFRMDEWGVDVAVTGSQKGFMLPAGLAIVGFSDRAMQATKTSTLPRTFFDVHDMQKGYDNNAFPYTPPVGLMNGLKLALEMIEEEGLENVFTRHRRIATGVRLAVKAWGLELCAVSPDVYSDTVSAIKTPDGFNATDIVTRAADKYGMAFGVGLGEVAGNVFRIGHLGMLTDAMMLSGLGVAEMVMVDLGLDVKLGSGVAAAQQFYRHGI

SEQ ID NO: 490 - protein, 396 aa, Methylopila sp. M107
MHMQNPVFIPGPTNIPEVLRKAVDMPTLDHRSSLFGDILAPALAGSKQVLKTETADCFILPATGTGGWETAICNTLSPGDAVLAARHGMFSHRWIDMCRRHQLSVEKVDGRWGTAAPADRFEEILAGDKAHRIKAVLVTHNETATGVRSNIREIRTAIDRARHPAFLFVDGVSSIGSMDFRMDEWGVDVAVTGSQKGFMLPAGLAIVAFSQRAMEATARAKLPRAFFDIRDMAKSYASGGYPYTPTVGLLNGLKVSTELLLAEGLDSVFARHRRIATGVRAAVAAWGFRLCAEEPSIYSETVSAIRTPEGFDATSIVTHASRKYDVAFGVGLGDVAGKVFRIGHIGSLTDVMALSGIAAAEMAMVDLGLKVDLGSGVSAAQDVYRMAHDTEALAAA

SEQ ID NO: 491 - protein, 396 aa, Loktanella sp. SE62
MSFQNPVFIPGPTNIPEAIRKACDMPTIDHRSPIFGQILQPAREGVRAVLISQDAEIIIIPASGTGGWETALTNTLSPGDTVLAARNGMFSQRWIEMCRRLGLAVEIVDTPWGNGIPADRYEEALRADKHHKIKAVLATHNETATGVASDIAAVRRAMDAANHPALLFVDGVSSIGSIDFRFDDWGVDVAVTGSQKGFMLPAGLAILGFSPKALDAGKHATMPRAYFDVADMQASYAKNSYPYTPSVGLLNGLLLSTQMLLAEGLENVFARHTRIATGVRAAVQAWGLKLCAASPDLYSDTVSAIMTPPGFNATDIVTHAAETYGVAFGVGLGEVAGKLFRIGHLGSMTDVMALSGIATAEMCMVDLGLDITLGSGVAAAQDYYRGSTGHVMKDAA

SEQ ID NO: 492 - protein, 396 aa, Phaeobacter gallaeciensis ANG1; identical to SEQ ID NO: 386

SEQ ID NO: 493 - protein, 396 aa, Rhodobaca barguzinensis DSM 19920
MSTHNPVFIPGPTNIPEEIRKACDIPTLDHRSPAFARLFKPAVAGIRRVLAMDQGEIIILPSTGTGGWEAAITNTLSSGDKVLAPRFGMFSHRWIDLCQRHGLDVQIIETPWGQGAPLAEIEAALRADSAHEIKAVLATHNETATGVRSDIAGIRRALDAAGHPALLLVDGVSSIGSMPFDMAGWGVDIAVAGSQKGFMLPAGLAILGVSPKALNAMEKATLPRTFFDFRDMLAAYAAGGYPYTPAVGLIAGLAKAIEMLEDEGLENVYARHHRLAEATRRAVAAWGMRPCAATPELYSDTVTAVVVPEGCNGTDLVQLAASKYGVAFGVGLGEVAGKVFRIGHLGMLSDVMLLSGLATAEMCMADLGWDVQLGSGVAAAQEYLRNSAGVALARAA

SEQ ID NO: 494 - protein, 396 aa, Mameliella alba DSM 26384
MTDQNPVFIPGPTNMPDRLRRAIQIQTRDHRAPDFVDTFAPVLEDTKKVFGSTEGKIITFPASGTGGWEAAVTNTLSPGDKILVGRYGVFSNKWIDLCQRHGLDVQIVETPWGEGVPADKFAEILSADTAHEIKAVLTTHNETATGVRSDIAAVRRALDGADHPAMLFVDCVSSLASMPFEFDAWGVDIAVSGSQKGFMLPTGMAILCVSPKALAAIETAGLSRTFFDFRDMMKANATGGFPYTPPLQLIYGLRESLDMLFEEGLENVFARHFRLAEGVRRAVDAWGMKLVAKSPDLYSDTVSAVYVPEGFDSNALTDHAYRAYKVSFGVGLGQLDGKAFRIGHLGSLTDVMVLSGLATIEMAMADLNYPITLGSGVAAAQEYYRTSRVAALKSAA

SEQ ID NO: 495 - protein, 396 aa, Paracoccus denitrificans DSM 15418; identical to SEQ ID NO: 8

SEQ ID NO: 496 - protein, 396 aa, Ruegeria halocynthiae MOLA R1/13b
MSNQNPVFIPGPTNIPDRLRLAMHVQTQDHRAPDFVDTFMPVLEGTKKVFGTTTGQIVTFPASGTGGWEAAITNTLSPGDKVLVARYGVFSHRWIDLCERHGLDVQVIECPWGSGAPADQFQTALADDTAHEIRAVLVTHNETATGVRSDISAVRRAMDVTDHPAMLFVDCVSSLASMPFAFDDWGVDIAVSGSQKGFMLATGMAILCVSPKAQEAMASAKLPRTFFDFGDMMAANASGGFPYTPPLQLIYGMRESLNMLFEEGLENVYARHFRLAEGVRRAVDAWGLKLVAQSPDLYSDTVSAIYVPDGFDSNALTDHAFNTYDVSFGVGLGQMNGRAFRIGHLGSLTDVMVLSGLGAIEMAMADLDYPIVLGSGVAAAQDYYRSGPSDSAKAAA

SEQ ID NO: 497 - protein, 396 aa, Roseivivax isoporae LMG 25204
MSMQNPVFIPGPTNIPEALRRACDMPTIDHRSPLFGQILHPARTGVRRVLKSDSAEIFLFPSTGTGGWETALSNTLSPGDGVLVARNGMFSARWIDMCERHGLEMTIIETPWGEGIPADRFEEALTADTGHRIKAVLATHNETATGVRSDIAAVRRAMDAAGHPAMLFVDGVSSIASMDFRFDEWGVDVAVTGSQKGFMLPPGLAILGFSQRALEARATATLPRTFFDTRDMERGYAANGYPYTPAVGLMNGLNIACDMLLSEGLEAVFARHHRIAEGVRAAVAAWGLKLCAVRPELQSDTVSAIRTPEGFDANRIVAHAAEAYGVAFGTGLGAVAGKVFRIGHLGSLTDVMALSGIATAEMVMADLGLPVTLGSGTAAAQEVYRATRATALKDAA

SEQ ID NO: 498 - protein, 396 aa, Citreicella thiooxidans DSM 10146
MSFQNPVFIPGPTNIPESLRKACDMPTIDHRSPLFGQILHPAREGVRKVLKSDAAEVFIFPSTGTGGWETALSNTLSPGDTVLAARNGMFSHRWIDMCQRHGLSVEIVETPWGEGLPAHRYAEILAADKQHRIKAVLATHNETATGVRSDIAAVRRALDDAGHPALLFVDGVSSIASMDFRFDEWGVDCAVAGSQKGFMLPPGLAIVGFSDKAMAATQTARLPRTFFDVQDMAKGYANNAYPYTPAVGLLNGLNEACRMLLDEGLENVFARHHRIAEGVRCAVRAWGLELCAASPEVYSDTVSAIRTPDGFNATDIVSHAAQTYGVAFGTGLGEVAGKVFRIGHLGSLTDVMTLSGLATAEMCMKDLGLDITLGSGVAAAQEFYRATPALARKAAA

SEQ ID NO: 499 - protein, 396 aa, Antarctobacter heliothermus DSM 11445
MSFQNPVFIPGPTNIPESLRKACDMPTIDHRSPLFGQILHPAREGVRNVLKSDSAEVFIFPSTGTGGWETALTNTLSAGDKVLSARNGMFSHRWIDMCQRHGLVVQIVETPWGEGVPADRYEEILTADKNHQIKVVLATHNETATGVKSDIAAVRRALDAAGHPALLFVDGVSSIGSMDFRFDEWGVDVAVTGSQKGFMLPAGLGIVGFSAKAMAATKTGTLPRTFFDVHDMAKGYANNAYPYTPAVGLLNGLNVACGMLLNEGLENVFARHTRIASGVRAAVSAWGLELCAATPSVYSDTVSAIRTPEGFNATDIVTHAADRYGVAFGVGLGEVAGKVFRIGHLGSLTDVMMLSGIATAEMCMADLGLDITLGSGVAAAQDYYRSHGVAAQKDAA

SEQ ID NO: 500 - protein, 398 aa, Nitratireductor sp. ZZ-1
MSTQNPIFIPGPTNIPERLRRAVDYPSIDHRSPAFAEMLKPAQDGVRRILRSKQAEIILFPSTGTGAWEAAITNTLSPGDKVLAARYGMFSHRWIDLCRRHGLEVEVIETPWGEGAPAEAFEEALKADAGHAIKAILVCHNETATGVVSDIAAVRRAIDAARHPALLYVDGVSSIASMDFRMDDWGVDIAITGSQKGFMLPAGLAILGIGPKAIQAVASAQCPRCFFDFRDMLKSNAGGGYPYTPPVNLIRGLSVSIAMLEEEGLPRVLARHHRIAEGVRRAVAAWGLSLCAQRPELYSDTVSAVVVPDGFDATRIVTHAAEKYGVAFGVGLGEVAGKLFRIGHLGSMTDVMALSGIATAEMVMADLGLPVTLGSGVAAAQEYYRTSRENAGSARAAA

SEQ ID NO: 501 - protein, 396 aa, Rhizobium sp. CNPSO 671
MYGQNPVFIPGPTNMPEILRKAADMPTMDHRSSMFGEILHPALAGVKQVLKSETASVFIFPATGSGGWETAITNTLSPGDRVLAGRHGMFSHKWIDMCRRYQLTVDAIESSWHDGVPLAQYEELLNGDKAHEIKAVLVTHNETATGVKSDVAAVRRLLNAANHPALLLVDGVSSIASMDFRMDEWGVDVAVTGSQKGFMLPVGLAITAFSAKAMAALETAKLPRAFFDVRDMAKGYSTNGYPYTPSVGLLNGLKVSTELLLQEGLENVFARHRRIASGVRAAVRAWRLELYAAREELYSETVTAVQTPAGFDASRFVTHAATKYDVAFGAGLGDVAGKVFRIGHVGSMTDVMALSGIATAEMVMVDLGLNIKLGSGVAAAQAIYRNSQSSASYMVA

SEQ ID NO: 502 - protein, 396 aa, Pseudomonas stutzeri NP_8HO
VSTQNPIFIPGPTNIPEVLRKAVDMPTIDHRSPMFGKILHPALEGVKKVLKSTQAQVFVFPSTGTGGWETAITNTLSEGDAVLATRNGMFSHRWIDMCQRHGLDVQIVDQSWGEGIPTDRFEEILTADTAHRIKAVLATHNETATGVRSDIAAIRRALDRAGHPAMLFVDGVSSIACYDFRMDEWGVDVAVTGSQKGFMLPPGLAIVGFSPKAMTAVEGASLPRTFFDIRDMARGYAANGFPYTPPVGLLNGLKVATDMLLDEGLENVFARHHRIAEGVRQAVAAWGMTLCAARPALYSDSVSAIRTPDGFDANRIVSHALKTYGVAFGTGLGDVAGKVFRIGHLGMLTDVMALSGLATAEMVMVDLGLPVTLGSGVAAAQAHYRHSAGQACRQAA

SEQ ID NO: 503 - protein, 396 aa, Ruegeria sp. ANG-R
MSNQNPVFIPGPTNIPDRLRLAMQVQTQDHRAPDFVETFGPVLEDTKQVFGTTKGQVVTFPASGTGGWEAAITNTLSPGDKVLVARYGVFSHRWIDLCERHGLNVQIVECPWGTGAPADRFEAILSADKAHEIRAVLVTHNETATGVLSDIGAVRRAMNAARHPAMLFVDCVSSLASMPFRFDQWGVDIAVSGSQKGFMLATGMAILCVSPKALAAMETARLPRTFFDFRDMMAANASGGFPYTPPLQLIYGMRESLKMLFEEGLDTVYARHHRLAEGVRRAVNAWGLKLVAQSPELYSDTVSAIYVPEGFDSNKLTDHAFDKYGVSFGIGLGEMNGKAFRIGHLGSLTDVMVLSGLATIEMAMADLNYPVNLGSGVAAAQEYYRAGSSSDAKAAA

SEQ ID NO: 504 - protein, 396 aa, Mameliella alba CGMCC 1.7290; identical to SEQ ID NO: 494

SEQ ID NO: 505 - protein, 397 aa, Pseudorhodobacter antarcticus CGMCC 1.10836
MTFQNPVFIPGPTNMPEHIRLACHMPTIDHRSPVFGKILHPCLEGVQRILKSTSAKVFIFPSTGTGGWEVALSNTLSKDGKVLAARNGMFSHRWIDMCQRHGLDVQIVETPWGHGLPADKYEEILRADKSHSIKVVLATHNETATGVKSDIAAVRRALDAANHPAMLFVDGVSSIGSMDFRMDEWGVDVAVTGSQKGFMLPAGLAIIGFSTKAMAAIDAATLPRTFFDVRDMAKGYANNAFPYTPPVGLMNGLKAAIEMIEGEGLENVFARHTRIATGVRHAVDAWGLKLCAAGPDVYSDTVSAICTPEGFNATDIVTVAARDYDMAFGVGLGEVAGKVFRIGHLGSLTDAMMLSGLATVEMVMVDLGLDIKLGSGVAAAQAHYRHGSNKSKRMAAE

SEQ ID NO: 506 - protein, 388 aa, Loktanella sp. DSM 29012
MSFQNPVFIPGPTNMPEHIRQACYMPTIDHRSPMFGKMLHPILDGVRRVMKSQSAHIFIFPSTGTGGWETALTNCLSAGDKVLAARNGMFSHRWIDMCQRHGLDVQIVETAWGDGLPADKYEEILKADTNREIKVVLATHNETATGVKSDIGAVRKALDAAEHPALLFVDGVSSIGSMDFRFDDWGVDVAVTGSQKGFMLPAGLAIVGFSDKAMKATETATLPRTFFDVKDMQKGYDNNAFPYTPPVGLMRGLEASLKLIEDEGLENVLARHTRIATGVRHAVDAWGLRLCANSPEVYSDSVSAIRTPEGFNATDIVTRSADKYGMAFGVGLGEVAGKVFRIGHLGLLTDAMMLSGLGVAEMVMVDLGLDIKLGSGVAAAQEFYRHGS

SEQ ID NO: 507 - protein, 396 aa, Paracoccus thiocyanatus ATCC 700171
MTSQNPIFIPGPTNIPEEMRKAVDMPTIDHRSPVFGRMLHPALEGVKKVLKSTQAQVFLFPSTGTGGWETAITNTLSPGDKVLAARNGMFSHRWIDMCQRHGLDVTFVETPWGEGIPADRFEEILTADKGHEIRAVLATHNETATGVKSDIAAVRRALDAAKHPAMLFVDGVSSIGSMDFRMDEWGVDIAVTGSQKGFMLPPGLAILGFSPKAMAAVESARLPRTFFDIGDMGEGYARNGYPYTPPVGLINGLNASCERILAEGLENVFARHHRIAGGVRAAVGAWGLKLCAARPELYSDSVSAIRVPEGFDANLIVSHALDTYDMAFGTGLGQVAGKVFRIGHLGSLTDAMALAGLATAEMVMADLGLPIRLGSGVAAAQDHYRQTTAAALKKAA

SEQ ID NO: 508 - protein, 392 aa, Rhodovulum sulfidophilum TUT; identical to SEQ ID NO: 425

SEQ ID NO: 509 - protein, 395 aa, Roseovarius sediminilitoris DSM 29439
MSFQNPVFIPGPTNMPESLRKAVDMPTLDHRSPLFGQILHPALEGVKKVLKSETAKVFIFPSTGTGGWETALTNTLSAGDKVLAARNGMFSHRWIDMCQRHGLDVQIVETPWGAGLPADKYADILKVDADHEIKVVLATHNETATGVRSDIAAVRKALDAANHPAMLFVDGVSSIASMDFRMDEWGVDIAVTGSQKGFMLPAGLAIVGFSPKAMAALETATLPRTFFDVRDMGNGYANNAYPYTPAVGLLNGLNEACKMLLDEGLENVFARHHRIAEGVRQAVSAWGLELCAVSKDVQSDTVSAIRTPEGFNATDIVTHAANKYGVAFGVGLGEVAGKVFRIGHLGSLTDVMTLSGLATAEMCMVDLGLDIKLGSGVAAAQEYYRANQLAMSKAA

SEQ ID NO: 510 - protein, 396 aa, Leisingera sp. ANG-M1
MSFQNPVFIPGPTNMPEALRKAVDMPTLDHRSPLFGQILHPALAGVKKVLKSENAEIFVFPSTGTGGWETAITNTLSAGDKVLAARNGMFSHRWIDMCQRHGLEVQVVETPWGEGLPADRYEEILTADTAHEIKVVLATHNETATGVKSDIAAVRRVLDAAGHPALLFVDGVSSIASMDFRMDEWGVDIAVTGSQKGFMLPPGLAIVGFSPKAMQAVKTASLPRTFFDIKDMALGYSNSAYPYTPSVGLLNGLNMACGMLLEEGLENVFARHHRIAEGVRSAVRAWGLELCAVSPEVYSDSVSAIRTPDGFDANKFVSLAAEKYGVAFGTGLGEVAGKVFRIGHLGSLTDVMALSGIATAEMVMADLGLNIPLGSGVAAAQDYYRGNTAASTKAAA

SEQ ID NO: 511 - protein, 397 aa, Roseovarius azorensis DSM 100674
MSDQNPVFIPGPTNIPDRLRRAMQVQTQDHRSPAFVNTLAPVLEGCKTVFGTTVGQIITFPASGTGGWEAAITNTLSPGDKVLVARYGMFSHRWIDMCQRHGLSVEIIECAWGSGAPADRFEEALKADNGHAIKAVLVTHNETATGVRSDIAAVRRAIQEADHPALLMVDCVSSLASMPFEMDKWGVDIAVSGSQKGFMLNTGMAILAVSPKALATMERAQLPRTFFDFRDMMSANGKGGFPYTPPLQLIYGMAESLDMLFEEGLDNVYARHTRLAEGVRRAVSGWGLRLVAQSPDLYSDTVSAVYVPEGFDSNALTEHAFANYGVSFGVGLGEMNGRAFRIGHLGSLTATMVLSGLATLEMAMADLKYPVRLGSGVIAAQEYYRATAKSTLTERAA

SEQ ID NO: 512 - protein, 396 aa, Sulfitobacter pseudonitzschiae DSM 26824
MSFQNPVFIPGPTNIPENLRKACDMPTIDHRSPLFGQILHPARAGVQKVLKSTSAEVFIFPSTGTGGWETALTNTLSAGDTVLAARNGMFSQRWIDMCQRHGLNVNVVETPWGQGVPADRYAEILAADTGHQIKAVLATHNETATGVRSNIAAVRQALDDAGHPAMLFVDGVSSIGSMEFRFDDWGVDVAVTGSQKGFMLPAGLGIVGFSAKAMEATKSAKLPRTFFDVHDMAKGYANSAYPYTPAVGLLNGLNTACGMLLDEGLANVFARHHRIAEGVRAAVGAWGLDLCAASPDLYSDTVSAIRTPEGFNATSIVTHAAEVYGVAFGVGLGEVAGKVFRIGHLGSLTDVMMLSGIATAEMCMADLGLDITLGSGVAAAQDYYRANRAERQQDAA

SEQ ID NO: 513 - protein, 396 aa, Ruegeria sp. CECT 5091
MSNQNPVFIPGPTNIPDRLRLAMQVQTQDHRAPDFVETFSPVLEDTKKVFGTKEGKIITFPASGTGGWEASVTNTLSPGDSVLVARYGMFSHRWIDLCQRHGLDVRIIECPWGSGAPADKFAEALAADKEHKIRAVLVTHNETATGVRSDIGAVRGAMDASDHPAMLFVDCVSSLASMPFEFDGWGVDIAVSGSQKGFMLATGMAILCVSPKALAAMETAQLPRTFFDFRDMMNANASGGFPYTPPLQLIYGMRESLKMLFEEGLNNVYARHFRLAEGVRKATAAWGLELVAQSPELYSDTVSAIYVPDGFDSNALTDHAFNAYGVSFGIGLGEMNGKAFRIGHLGSLTDVMVLSGLATIEMAMADLDYPIKLGSGVAAAQEYFRTSSATPMQSAA

SEQ ID NO: 514 - protein, 396 aa, Pseudoruegeria haliotis DSM 29328
MSFQNPVFIPGPTNMPEAVRQACYMPTIDHRSPTFGKILHPCLDGVRKVLKSDSAHIFIFPSTGTGGWETALTNTLSKGDKVLAARNGMFSHRWIDMCQRHGLDMQIVESPWGNGLPADHYEEILRADTGHKIKVVLATHNETATGVKSDIAAVRRALDAAGHPAMLFVDGVSSIASMDFRFDEWGVDVAVTGSQKGFMLPAGLAIVGFSDRAVAASKTAELPRTFFDIKDMQNGYNASAFPYTPPVGLMNGLKLSLDMLLSEGLENVFARHHRIAEGVRAAVRAWGLELCATSPDVYSDTVSAIRTPEGFNATDIVTHAADTFGVAFGVGLGEVAGRVFRIGHLGSLTDVMTLSGLGAAEMCMADLGLNIPLGSGVAAAQEYYRSHPSAALKSAA

SEQ ID NO: 515 - protein, 387 aa, Psychrobacter sp. ENNN9_III
MSLQNPIFIPGPTNIPDRLRRAMNVPTQDHRAPDFSDTFLPVLADCKKVFGTQDGEIILFTSSGTGGWEAAISNTLSPGDKVLIARYGMFSHRWIDMCQRHGLDVQIVECAWGTGAPADQFQAILSEDTAHEIKAVMVTHNETATGVLSDIGAVRKAMDSSDHPALLFVDGVSSIASVPFEMDDWGVDIAVAGSQKGFMLATGMAILGVSQKALSHMDEAKLPRTYFDFRDMLKANANGGFPYTPPLNLIYGMRASLDMLFEEGLENVYARHHRLAEGVRQAVSAWGFKLCAASPDLYSETVSAIYVPEGFDSNELTDHAFNKYGISFGIGLGEMHGKAFRIGHLGSLTEVMVLAGLATIEMAMVDLDYPIKLGQGVAAAQEYYRNN

SEQ ID NO: 516 - protein, 399 aa, Pararhodobacter aggregans DSM 18938
MTAHQAFAQNPVFIPGPTNMPEALRKACDVPTLDHRSPAFARMLAPALAGVKRVMGMESGEVFLLPATGTGGWEAAIANTLSPGDRVLAARYGVFSARWIDLCQRFGLEVEVLDTPWGEGLPLERIEAALRADRTGRIKTVLATHNETATGVRSDIAGLRRAMDRAGHEALMMVDGVSSIASMPFDFSGWGVDIAVTGSQKGFMLPPGLAILGLSDRALAAMENARLPRTYFDLKDMRRSMAAGGYPYTPPVGLIAGLAASVAMLEDEGLAAVHARHYRLAEGVRRAVAGWGLSTCAAGPALASDTVTAVLAPEGCDANAFVARAAGTYGMAFGTGLGQLAGKAFRIGHLGMLSDPLMLAGLATAEMVMADLGWPVRLGSGVVAAQDFYRGALPLAAAA

SEQ ID NO: 517 - protein, 392 aa, Rhodovulum kholense DSM 19783
MHALNPIFLPGPTNLPEALRRACDIPTMDHRSAAFGPILASAMAGVKQVLGLSEGEVAIFPATGTGGWEAAVTNTLRPGDKVLAARHGMFSRKWIDLCQRHGLDVEIVERPWGEGVPVEAFAAALAADTGHRIRAVLVTHNETATGVTSDVAAVRAAMTAAGHPALLMVDGVSSIGSIDFRMDAWGVDLAVTGSQKGFMLPAGLAIVGIGPKALAAMETSGLPRCFFDIRDMLGGNYPYTPPVGLINGLAVSTGLLLEEGMEAVRARHHRIAEGVRRAVAAWGMTTCAARPELCSDTVTAIVTPDGVDAGRIVRHAAEAYGVAFGGGLGEVADKVFRIGHLGLMSDVMALSGIATAEMAMTDLGLPVRLGSGVAAAQEHYRNSRTAPVRAAA

SEQ ID NO: 518 - protein, 396 aa, Rhizobium yanglingense LMG 19592
MYTQNPVFIPGPTNMPEVLRRATDLPTIDHRSAAFADILQPALAGVRKVVKSENAEIVVFPATGSGGWEATITNLLSPGDKVLAARCGMFSHRWIDMCQRHGLQVDTVHSSWQQPLPLAEYEKRLFADKGHDIKAVLVTHNETATGVKSDVGAVRRLLDDAKHPALLLVDGVSSIASMDFRMDEWKVDAAITGSQKGFMLPVGLAILALSPKAMQAAQSAKLHRAYFDIREMAKTYPSSGYPYTPSVGLLNGLKMSTELLLGEGLDNVFKRHARIASGVRAAVSAWGLRLYAQEESSFSDTVSAVETPDGFDATSIVTHAAQKYAVAFGAGLGDVAGRVFRIGHLGSMSDVMALSGIATAEMAMADLGLPIRLGSGVAAAQEIYRNSAASAIRNAA

SEQ ID NO: 519 - protein, 396 aa, Labrenzia sp. C1B70; identical to SEQ ID NO: 481

SEQ ID NO: 520 - protein, 396 aa, Ruegeria mobilis 45A6
MSFQNPVFIPGPTNIPESLRKACDMPTIDHRSPLFGQILHPARDGVRKVLKSETAEVFIFPSSGTGGWETALSNTLSAGDTVLAARNGMFSHRWIDMCQRHGLEVQIVETPWGAGLPADRYEEILSADKAHKIKAVLATHNETATGVKSDIAAVRRALDAAGHPALLFVDGVSSIASMDFRMDEWGVDVAVTGSQKGFMLSAGLAIVGFSPKAMEATKSAQLPRTFFDVHDMAKGYANNAYPYTPAVGLMNGLNESCKMLLAEGLENVFARHHRVAEGVRAAVGAWGLELCAATPEVYSDTVSAIRTPEGFNATDIVTHAADKYGVAFGLGLGEVAGKVFRIGHLGSLTDVMALSGIATAEMCMVDLGLDIQLGSGVAAAQEYYRGNAVSAQQDAA

SEQ ID NO: 521 - protein, 395 aa, Oceaniovalibus guishaninsula JLT2003
MSFQNPVFIPGPTNMPEAIRQACYMPTIDHRSPVFGRILHPCLDGVRRVLKSESAHIFIFPSTGTGGWETALTNTLSPGDTVLAARNGMFSHRWIDMCQRHGLTVQVIETPWGEGIPAGKMEEALRADKDRAIKVVLATHNETATGVKSDIAAVRRALDAAGHPAMLFVDGVSSIASMDFRFDEWGVDVAVTGSQKGFMLPAGLAIVGFSEKAMNAVETARLPRTFFDVRDMARGYANNAFPYTPPVGLMNGLKLSLQMIEDEGLENVFARHRRIATGVRRAVDAWGLELCAVSPDVQSDTVSAIRTPEGFNATDIVTVAARDYGMAFGVGLGEVAGKVFRIGHLGSLTDAMMLSGLGTAEMVMVDLGLPIKLGSGVAAAQDVYRRGGEARKAAA

SEQ ID NO: 522 - protein, 396 aa, Loktanella vestfoldensis DSM 16212
MSFQNPVFIPGPTNMPESIRKACDMPTIDHRSPLFGQILHPARANVQKVLKSDSAEVFIFPSTGTGGWETAITNTLSAGDTVLAARNGMFSHRWIDMCQRHGLDVQIVETPWGHGLPADRYADALQADKAHKIKAVLATHNETATGVKSDIAAVRAALDAADHPALLFVDGVSSIGSMDFRFDDWGVDIAVTGSQKGFMLPAGLAILGFSAKARAATKTAGLPRTFFDVNDMAKGYDNSAFPYTPPVGLMNGLLLASDMLLREGLDNVFARHTRIASGIRAAVHAWGLDLCAATPDLYSDTVSAINTPAGFNATQIVNHAASAYGVAFGTGLGEVAGKVFRIGHLGSMTDVMALSGIATAEMCMVDLGLDIKLGSGVAAAQEHYRRTTGQALKDAA

SEQ ID NO: 523 - protein, 396 aa, Rhizobium etli bv. mimosae Mim1
MYTQNPVFIPGPTNMPEVLRRAADLPTIDHRSAAFADILQPALAGVRKVVKSEDAEIIVFPATGSGGWEAAITNLLSPGDKVLAARHGMFSHRWIDMCQRHGLQMDVAHSSWKHPLPLAEYEKRLVADKGHDIKAVLVTHNETATGVKSDVGAVRRLLDEAGHPALLLVDGVSSIASMDFRMDQWKVDAAITGSQKGFMLPVGLAILALSAKAMQAVQSAKLRRGFFDIREMAKSYPASGYPYTPSVGLLNGLKVSTELLLGEGLDNVFKRHARIASGVRAAVSAWGLRLYAQEASSFSDTVSAVETPEGFDATSIVTLAAQKYGVAFGAGLGDVAGRVFRIGHLGSMSDVMALSGIATAEMAMADLGLPIRLGSGVAAAQEIYRNTAASPVRKAA

SEQ ID NO: 524 - protein, 396 aa, Methylobacterium komagatae DSM 19563
MFAQNPVFIPGPTNMPEVLRRAADMPTLDHRSPYFAQILHPALAGVKKVLKSETAEVFIFPSTATGGWETALSNTLSVGDAVLASRYGMFSHRWIDMARRHGLDVRVIEAPWGQGLPADRFAEALSADKAHRIKAVLVTHNETATGVKSDVAAVRRALDATGHPALLLVDGVSSIASMDFRMDEWGVDVAVTGSQKGFMLPAGLAITAFSPKAMDATATATLPRTYFDIRDMAKGYANGAYPYTPSVGLLNGLKLSTELLLAEGLDAVFARHRRIADGIRAAVSAWGLELCAARPELYSDTVSAIRTPEGFDATQIVTHAARQYDVAFGVGLGEVAGKVFRIGHLGSLTDVMALSGIAAAEMAMADCGLRIELGSGVAAAQAVYRGAAGTRLRAAA

SEQ ID NO: 525 - protein, 396 aa, Rhizobium tropici YR635
MYMQNPVFIPGPTNMPEILRKAADMPTLDHRSPLFGQILRPALAGVKKILKTEAASVYVFPSTGTGGWETAITNTLSPGDRVLAARYGMFSQRWIDMCQRHGLKVDIIEAAWGGGAPAARYEEILAADTAHEIKAVLVTHNETATGVKSDIAAVRRAIDAARHPALLFVDGVSSIASMDFRMDEWLVDIAVTGSQKGFMLPAGLAITAFSPKALAAVETAKLPRTFFDIGDMARSYANNAYPYTPAVGLLNGLKLSTELLLAEGLENVFARHRRIASGIRAAVRAWGLELCAMSEDLYSDTVSAIRTPEGFDATSIVAHAAKTYDVAFGVGLGEVAGKVFRIGHLGSLTDVMALSGIATAEMVMVDLGLDIKLGSGVAAAQDYYRDGRASKVRAAA

SEQ ID NO: 526 - protein, 396 aa, Aurantimonas altamirensis DSM 21988
MYMQNPVFIPGPTNMPEVLRRAADMPTLDHRSPRFAEILHPALAGVRKVIKGASSEVFVFPSTGTGGWETAITNTLSPGDTVLAARFGMFSHRWIDMCRRHGLNVELVEEAWGNALPIEAYEARLRADRQHRIKAVLATHNETATGVRSDIAAVRRALDAANHPAMLFVDGVSSIASMDFRMDEWGVDIAVTGSQKGFMLPVGLAIVACSPRAMDVMADAKLPRTFFDIADMRARYADGAYPYTPSVGLLNGLKLATEMLLTEGLDNVFARHRRIAEGVRAAARAWAMPLCATRPEIASDTVTAVMTPQGFDATRLVAHASTKYDVAFGVGLGEVSGKLFRIGHLGSLSDVMALSGIATAEMAMADLGLPITLGSGVAAAQEHYRSTQAAEARLAA

SEQ ID NO: 527 - protein, 396 aa, Sulfitobacter sp. MCCC 1A00686; identical to SEQ ID NO: 512

SEQ ID NO: 528 - protein, 396 aa, Methylobacterium sp. 13MFTsu3.1M2
MFAQNPVFIPGPTNMPEVLRRAADMPTLDHRSPLFAQILHPALAGVKKVLKSEDAEVFIFPSTATGGWETALSNTLSAGDTVLAARHGMFSHRWIDMTRRHGLDVRMIEAPWGEGLPADRFAEALAADKAHRIRAVLVTHNETATGVRSDVAAVRRALDASNHPALLLVDGVSSIASMDFRMDEWGVDVAVTGSQKGFMLPAGLAIVAFSPKAMAATATATLPRTYFDIRDMAKGYPNGAYPYTPAVGLLNGLKLSTELLLAEGLETVFARHRRIADGIRAAVAAWGLELCAARPDLYSDTVSAIRTPEGFDATRIVTHAARHYDVAFGVGLGEVAGKVFRIGHLGSLTDVMALSGIAAAEMAMVDLGLRIALGSGVAAAQAVYRRAPAAALRAAA

SEQ ID NO: 529 - protein, 396 aa, Methylobacterium sp. 275MFSha3.1; identical to SEQ ID NO: 419

SEQ ID NO: 530 - protein, 396 aa, Paracoccus pantotrophus DSM 11073; identical to SEQ ID NO: 408

SEQ ID NO: 531 - protein, 396 aa, Marinovum algicola DSM 10251
MSFQNPVFIPGPTNIPENLRKACDMPTIDHRSPLFGQILHPAREGVRKVLKSDSAEVFIFPSTGTGGWETALTNCLSAGDKVLSARNGMFSHRWIDMCQRHGLDVQIVETPWGEGLPADRFEEILTADTNHEIKAVLATHNETATGVKSDIAAVRKALDAAGHPALMFVDGVSSIGSMDFRFDEWGVDVAVAGSQKGFMLMAGLAIVGFSEKAMAATQTATLPRTFFDVHDMKKGYANSAYPYTPAVGMLNGLNQACTMLLDEGLENVFARHHRIAEGVRAAVGAWGLELCAASPDLYSDTVSAIRTPEGFNATDIVSHAASKYGVAFGVGLGEVAGKVFRIGHLGSLTDVMTLSGLATAEMCMADLGLDITLGSGVAAAQEYYRGHAVAARKSAA

SEQ ID NO: 532 - protein, 396 aa, Paracoccus versutus DSM 582
MTSQNPIFIPGPTNIPEEMRKAVDMPTIDHRSPVFGRMLHPALEGVKKVLKTTQAQVFLFPSTGTGGWETAITNTLSPGDKVLAARNGMFSHRWIDMCQRHGLDVTFVETPWGEGIPADRFEEILAADKGHEIRVVLATHNETATGVKSDIAAVRRALDAAKHPAMLFVDGVSSIGSMDFRMDEWGVDIAVTGSQKGFMLPPGLAIVGFSPKAMAAVESARLPRTFFDIRDMATGYARNGYPYTPPVGLINGLNASCERILAEGLENVFARHHRIAGGVRAAVEAWGLKLCAARPELYSDSVSAIRVPEGFDANLIVSHALETYDMAFGTGLGQVAGKVFRIGHLGSLTDAMALSGIATAEMVMADLGLPIKLGSGVAAAQEHYRQTTAAAQKKAA

SEQ ID NO: 533 - protein, 396 aa, Thalassobius aestuarii DSM 15283
MSFQNPVFIPGPTNIPESLRKACDMPTIDHRSSLFGQILHPARAGVRKILKSETAEVFIFPSTGTGGWETALTNCLSSGDKVLAARNGMFSHRWIDMCQRHGLDVQVVETPWGEGLPADRYEEILTADTAHKIKVVLATHNETATGVKSDIAAVRRALDAAGHPALLFVDGVSSIASMDFRMDEWGVDVAVTGSQKGFMLTAGLAIVGFSAKAIEATKSATLPRTFFDINDMTAGYANNAYPYTPAVGLLNGLNEACAMLLNEGLENVFARHHRIAEGVRAAVGAWGLELCAANPSVYSDTVSAIRTPDGFNATDIVTHAASKYGVAFGVGLGEVAGKVFRIGHLGSLTDVMALSGIATAEMCMVDLGLDVRLGSGVAAAQEYYRGHGIEAQKDAA

SEQ ID NO: 534 - protein, 396 aa, Litoreibacter janthinus DSM 26921
MSFQNPVFIPGPTNMPECLRRACDMPTLDHRSSLFAEILHPARDGVRQVMKASDAEIFIFPSTGTGGWETAITNTLSRGDTVLAARNGMFSQKWIDMCQRHGLNVKIVEAAWGEGIPTDQFEEILTADKNHQIKAVLATHNETATGVLSDIAGVRAAMSAAQHPALLFVDGVSSIGSMDFRFDDWGVDVAVTGSQKGFMLPAGLGIAGFSRKAMDAAKTAGLPRTYFDIRDMSKGYAANAYPYTPAVGLLNGLKLACGMLLDEGLDAVFARHARIANGVRGAVEAWGLELCAVRPELYSDTVSAIRTPEGFDAGRIVSHASQNYRVAFGVGLGLVAGKVFRIGHLGSLTDVMTLSGIATAEMVMADLGLDITLGSGVAAAQEIYRSTAAPMVLAAE

SEQ ID NO: 535 - protein, 396 aa, Paracoccus sp. 361
VSTQNPIFIPGPTNIPEVLRKAVDMPTIDHRSPMFGKILHPALEGVKKVLKSTQAQVFVFPSTGTGGWETAITNTLSAGDAVLATRNGMFSHRWIDMCQRHGLDVQIVDQSWGEGIPTDRFEEILTADTAHRIKAVLATHNETATGVRSDIAAVRRALDRAGHPAMLFVDGVSSIACYDFRMDEWGVDVAVTGSQKGFMLPPGLAIVGFSPKAMTAVEGAGLPRTFFDIRDMARGYAANGFPYTPPVGLLNGLKVATDMLLDEGLENVFARHHRIAEGVRQAVAAWGMTLCAARPTLYSDSVSAIRTPDGFDANRIVSHALNTYGVAFGTGLGDVAGKVFRIGHLGMLTDVMALSGLATAEMVMVDLGLPVTLGSGVAAAQAHYRHSAGQACRQAA

SEQ ID NO: 536 - protein, 396 aa, Paracoccus homiensis DSM 17862
MSFQNPVFIPGPTNIPESLRKACDMPTIDHRSPLFGQILHPAREGVRKILKSASAEVFIFPATGTGGWETALTNTLSAGDKVLAARNGMFSHRWIDMCQRHGLQVEIVETPWGQGLPADRYADILAADTAHQIKAVLATHNETATGVKSDIAAVRRALDDAGHPAMLFVDGVSSIGSMDFRFDEWGVDIAVTGSQKGFMLPAGLAIVGFSEKAMAATQTGTLPRTFFDVHDMAKGYANNAYPYTPAVGLLNGLNQSCTMLLAEGLENVFARHRRIAQGVRAAVEAWGLPLCAAHPSLYSDTVSAIRTPEGFNATDIVTHAAEKYGVAYGVGLGEVAGKVFRIGHLGSLTDVMALSGIATAEMCMADLGLDIKLGSGVAAAQDFYRGNPAIACKDAA

SEQ ID NO: 537 - protein, 396 aa, Ponticoccus sp. UMTAT08
MTDQNPVFIPGPTNMPDRLRRAIQIQTRDHRAPDFVDTFAPVLEDTKKVFGSTEGKIITFPASGTGGWEAAVTNTLSPGDKILVGRYGVFSNKWIDLCQRHGLDVQIVETPWGEGVPADKFAEILAADTAHEIKAVLTTHNETATGVRSDIAAVRRALDGADHPAMLFVDCVSSLASMPFEFDAWGVDIAVSGSQKGFMLPTGMAILCVSPKALAAIETAGLSRTFFDFRDMMKANATGGFPYTPPLQLIYGLRESLDMLFEEGLENVYARHFRLAEGVRRAVDAWGMKLVAKSPDLYSDTVSAVYVPEGFDSNALTDHAYRAYKVSFGVGLGQLDGKAFRIGHLGSLTDVMVLSGLATIEMAMADLNYPITLGSGVAAAQEYYRTSRVAALKSAA

SEQ ID NO: 538 - protein, 404 aa, Marinobacter psychrophilus 20041
VTGLLVIAITERERLMSDQNPIFIPGPTNIPDRLRFAMNVQSSDHRSPGFVETLSPLLQDCKKVFNTQSGEVILFPASGTGGWEAAICNTLSPGDKVLIARYGMFSRRWIDMCQRHGLDVQIIECPWGSGAPANEFKRALSADTQHKIKAVLVVHNETATGVKSDIDAVRQAMDSCSHPALLLVDCVSSLASMPFEMDNWGVDIAVSGSQKGFMLITGMAILAVSQKALAEMETAKLSCAFFDFRAMMTANAQGGFPYTPPLQLICGLKESLKMLFEEGLDNVYARHFRLAEGVRQATHAWGMALCAQSPDLYSNTVTAIYVPEGFDSNELTDHTLAKYGVSFGIGLGEMHGKAFRIGHLGSLTDSMVLSGLATIEMAMADLDYPIELGSGVRAAQNHFRATTA

SEQ ID NO: 539 - protein, 396 aa, Methylobacterium sp. Leaf361; identical to SEQ ID NO: 419

SEQ ID NO: 540 - protein, 396 aa, Aestuariivita boseongensis BS-B2
MSFQNPVFIPGPTNIPEVIRKACDMPTIDHRSPLFATILHPALDGVRAVMKQTKGETFIFPASGTGGWETALSNTLNPGDTVLAARNGMFSHKWIDMCQRFGLKVRQVDVTWGEGLPVATFEEILRDDTAGEIKAVLATHNETATGVVSDVGGLRRAMDAAGHGALLLVDGVSSIGSMDFQFDDWGVDVAVTGSQKGFMLPAGLAIVGFSEKAVAASKTNSLPRTFWSIDDMRNGYAANAYPYTPAVGLMNGLKLATEMLLGEGLDNVFARHARIAEGVRAATFAWGMKPCAVSPDLYSNTVTAIRTPEGFNASDIVARAAQEYGMAFGTGLGDVAGKVFRIGHLGSLTDAMALSGIATAEMVMADLGLPIQLGSGVAAAQEIYRHGNTSQRMAAQ

SEQ ID NO: 541 - protein, 396 aa, Paracoccus isoporae DSM 22220
MSFQNPVFIPGPTNIPESLRKACDMPTIDHRSPLFGQILHPALAGVRKVLKSDQAEIFIFPSTGTGGWETALTNTLSPGDKVLAARNGMFSHRWIDMCQRHGLEVQIVETPWGHGLPADRYEEFLTADKNHEIKVVLATHNETATGVRSDIAAVRRALDAAGHPAMLFVDGVSSIASMDFRFDEWGVDIAVTGSQKGFMLPPGLAILGFSKKAMAAIDSATLPRTFFDVRDMGKSYGNNAYPYTPAVGLLNGLNQACGMLLDEGLENVFARHHRIAEGVRAAIAAWGLELCAVSPDVYSDTVSAVRTPEGFNATDIVTHAASNYGVAFGVGLGEVAGKVFRIGHLGSLTDVMTLSGIATAEMCMADLGLDISLGSGVAAAQEYYRSTQSAARKDAA

SEQ ID NO: 542 - protein, 396 aa, Aminobacter aminovorans KCTC 2477
VTSQNPIFIPGPTNIPEVLRKAVDIPTVDHRSPLFAKILHPALDGVKKVMKTGRAEIIVFPSTGTGGWEAAITNTLSPGDKVLATRNGVFSHRWIDMCQRHGLDVVVVAQQWGDGIPADRLAEILAADKSHEIKAVLATHNETATGVRSDIAAVRGALDAAGHPAMLFVDGVSSIGSMDFRMDEWGVDIAVTGSQKGFMLPPGLAIVGLSPKAMESVADGRLPRTFFDVRDMISNYSAGGFPYTPPAGLLNGLKTATEMLLDEGLENVFARHRRIAEGVRRAVDAWELHLCAMRPELYSDTVSAIRVPDGFDANRIVAHALNAYGVSFGTGLMELAGKVFRIGHLGSLTEVMALSGIATAEMAMADLGLAVRLGSGVAAAQEHFRLGAAYARQKAA

SEQ ID NO: 543 - protein, 396 aa, Aminobacter aminovorans KCTC 2477
MAGFNQLFVPGPTNVPESVRQAMNMPMEDMRAPDYPTFTRGLFTDLMKVFRNETGRAFIFPSSGTGAWESAITNTLSPGDRVLMSRFGQFSHLWVDMAERFGLDVDVVDVEWGTGVPVEIYAERLAADKEHRIKAVFVTHNETATGVTSDVGAVRAALNAAKHPALLFVDGVSSVGSIDFRQEEWGVDCAVSGSQKGFMLPPGLGFLSVSQKALNAAKTAKFSRCYFSFEDQIRANDTGYFPYTPAVQLLRGLRAALDLIQEEGLDNIFERHHRLATGVRKAVDAWGLRVCAKEAKWNSDTVSAIVVPEGIDSADIVRRAYNGYQTSLGVGLNKVAGKVFRIGHLGWVNEVMMCGAISAAEMSLRDCGVKVQPGSGVGAALEHYRLSAQPAVAKAA

SEQ ID NO: 544 - protein, 396 aa, Aminobacter aminovorans KCTC 2477
MSSQNPIFIPGPTNIPEVLRKAVDMPTIDHRSPLFGKILHPALDGVKKVLKTTQAEVFAFPSTGTGGWEMAISNTLSAGDKVLATRNGMFSHRWIDMCQRHGLDVTVVTQNWGEGIPANIFEEMLVADKAHEIKAVLATHNETATGVRSDIAAVRRALDAAGHPALLFVDGVSSIGCMDFRMDEWRVDVAVAGSQKGFMLPPGLAIVACSSLALAAAETAGLHRTFFDLRDMAKGYANSGYPYTPPVGLLNGLKLSTEMLLEEGIENVFARHHRIACGVRAAVAAWGLRLCAGRPELYSDTVSAIRVPEGFDANKIVSHALNAYGVAFGTGLGDVAGKVFRIGHLGSLTEVMALAGVATAEMVMVDLGLPITLGSGVAAAQQHYRQSIGSPQLKAA

SEQ ID NO: 545 - protein, 397 aa, Loktanella litorea DSM 29433
MSFQNPVFIPGPTNMPEAIRKACDMPTIDHRSPLFGQILHPVRANVREILKSTSAEIFIFPSTGTGGWETAITNTLSPGDTVLAARNGMFSHKWIDMCQRHGLNVMMVETAWGQGIPTDRFAEILADDKDHKIKAVLATHNETATGVRSDIAGVRRAMDTSNHPAMLFVDGVSSIASMDFRFDEWGVDVAVTGSQKGFMLPAGLAIVGFSKRAVEATKTAGLHRTFFDINDMTKGYDANAYPYTPAVGLMNGLLLATETLLKEGMENVFARHNRIASGVRAAVDAWGLELCAASPDLYSDTVSAIMTPEGFNASDIVSHAAEKYGVAFGTGLGDVAGKVFRIGHLGSMTDVMALSGIATAEMCMVDLGLDIKLGSGVAAAQEFYMGKTQTVPMKDAA

SEQ ID NO: 546 - protein, 392 aa, Marinobacterium lutimaris DSM 22012
MSDQNPVFIPGPTNIPDRLRNAMHIQTRDHRAPDFVETFAPVLEDCKRVFGTETGQVITFPASGTGGWEASICNTLSAGDTVLVARYGMFSHRWIDLCQRHNLEVQVIDCEWGSGAPADLFEQALKADTEKTIKAVLVTHNETATGVKSDIAAVRRAMDAASHPAMLFVDCVSSLASMPFHMDDWGVDIAVSGSQKGFMLATGMAILGVSQKALAAMETATLPRTFFDFRDMMAANASGGFPYTPPLQLIYGMRESLKMLLEEGLDNVYARHFRLAEGVRKAVEAWGMKLCAQSPELYSDTVSAIYVPEGFDSNELTEHAFNAYGVSFGIGLGEMNGKAFRIGHLGSLTDVMVLSGLASIEMAMADLNYPIELGSGVRAAQEYYRATAAANQ

SEQ ID NO: 547 - protein, 397 aa, Rubrimonas cliftonensis DSM 15345
MQGQNPVFIPGPTNIPDRLRHAMNMQTLDHRAPDFVDLLTPVRAGLKKVLKTETAEVVTFPGSGTGGWEAAVSNTLSPGDTVLAARYGMFSHRWIELCQRLGLTVQVIETPWGEGAPADRIEEALAADKGHAIKAVLATHNETATGVRSDIAAVRRAMDAAGHPAMLYVDGVSSIASMDFRMDEWGVDLAVTGSQKGFMLYTGMAIVGVSRKALQAMETAACPRAYFDFRDMIGANAKGGYPYTPPLQLLFGLGESLKMLLDEEGLDAVFARHHRMAEGVRRAVAAWGMKLCANRPELCSDTVSAIYVPEGFKSDALVNHAFRTYGMSFGVGLGEMAGRAFRIGHLGSLTPSMALSGIATVEMAMADLNYPITLGAGVAAAQDYYRTTAGVPQQKAA

SEQ ID NO: 548 - protein, 388 aa, Planktotalea frisia SH6-1
  MISC_FEATURE (1)..(388): PFRI
MSFQNPVFIPGPTNMPEEIRLATYMPTIDHRSPVFGGILHPCLDGVRRVLKSETAHIFIFPSTGTGGWETTLTNTLSAGDKVLVARNGMFSHRWIDMCERHGLDVQVVDVAWGEGLPVAEYAAILKADKDHTIKAVLATHNETATGVKSDIAGVRGALDAANHPALFFVDGVSSIGSMDFRMDEWGVDVAVTGSQKGFMLPAGLAIVGFSEKARAAVESATLPRTFFDIRDMEKGYAANAFPYTPPVGLMNGLKCAIEMIEAEGLENVFARHTRIATGVRHAVEAWGLELCANAPELYSDSVSAIRTPEGFNATDIVTRADEQYGMAFGVGLGDVAGKVFRIGHLGMLTDAMMLSGLGVAEMVMKDLGLDIKLGSGVGAAQEFYRYGS

SEQ ID NO: 549 - protein, 396 aa, Aureimonas altamirensis ON-56566
MYMQNPVFIPGPTNMPEVLRRAADMPTLDHRSPRFAEILHPALAGVRKVIRSASAEVFVFPSTGTGGWETAITNTLSPGDTVLAARYGMFSHRWIDMCRRHGLNVELVEEAWGNALPVEAYEARLRADRQHRIKAVLATHNETATGVRSDIAAVRRALDAANHPAMLFVDGVSSIASMDFRMDEWGVDIAVTGSQKGFMLPVGLAIVACSPRAMDMMADAKLPRTFFDIADMRARYADGAYPYTPSVGLLNGLKMATEMLLTEGLDNVYARHRRIAEGVRAAARAWAMPLCATRPEIASDTVTAVMTPQGFDATRLVAHASAKYDVAFGVGLGEVSGKLFRIGHLGSLSDVMALAGIATAEMAMADLGLPITLGSGVAAAQEHYRSTQAAEDRLAA

SEQ ID NO: 550 - protein, 389 aa, Marinobacter sp. Hb8
MFEQNPIFIPGPTNIPDRLRHAMNVQSSDHRSPDFVETLAPLLQDCKKVFGTQSGEVVLFPSSGTGGWEAAICNTLSPGDKVLIARYGMFSHRWIDMCQRHGLDVQIIECSWGSGAPADEFQRALSADTQHEIKAVLVTHNETATGVKSDIGAVREAMDSSAHPALLLVDCVSSLASMPFEMDDWGVDIAVSGSQKGFMLVTGMAILGVSQKALAAMENAELSRTFFDFRGMMAANAQGGFPYTPPLQLIYGLRESLKMLFEEGLDNVYARHFRLAEGVRQAVKAWGLDLCAQSPELHSHTVSAIYVPKGFDSNKLTDHAFSKYGVSFGIGLGEMYGKAFRIGHLGSLTDTMVLSGLATIEMAMADLDYPIELGEGVRAAQSYFRKTAA

SEQ ID NO: 551 - protein, 396 aa, Ruegeria sp. ZGT108
MSNQNPVFIPGPTNIPDRLRLAMQVQTQDHRAPDFVNTLAPVLEGTKKVFGSASGQIITFPASGTGGWEAAVTNTLSPGDTVLVARYGMFSHRWIDLCQRHGLDVRIIECAWGSGAPADQFAKALAADTAHQIRAVLVTHNETATGVRSDISAVRKAMDASDHPAMLFVDCVSSLASMPFAFDDWGVDIAVSGSQKGFMLATGMAILCVSPKALAAIETAKLPRTFFDFKDMMNANASGGFPYTPPLQLIYGMRESLNMLFEEGLDNVYARHTRLAEGVRKATAAWGLDLVAQSPELYSDTVSAIYVPEGFDSNALTDHAFNAYGVSFGVGLGEMNGKAFRIGHLGSLTDVMVLSGLATIEMAMADLNYPIDLGSGVSAAQEYFRSGRTTPMKTAA

SEQ ID NO: 552 - protein, 395 aa, Paracoccus sediminis DSM 26170
MTSQNPVFIPGPTNIPEVLRKAVDMPTIDHRSPVFGRILHPALEGVKKVLKTTDGQVFVFPSTGTGGWETAITNTLSPGDKVLATRNGMFSHRWIDMCQRHGLDVQVVAQEWGEGVPADRFEEILTADKGHEIKVVLATHNETATGVRSDIAAVRRALDAAGHPALLFVDGVSSIACYDFRMDEWGVDVAVTGSQKGFMLPPGLAIVGFSPKAMAAVETAKLPRTFFDIRDQARGYAANGFPYTPPVGLLNGLNVACQMLLDEGLENVFARHHRIAEGVRRAVAAWGMPLCAKRPDLYSDSVSAIRVPEGFDANKIVSHALNAYGVAFGTGLGDVAGKVFRIGHLGSLTDVMALSGIATAEMVMADLGLPVTLGSGVAAAQDHYRHSVPAMQKAA

SEQ ID NO: 553 - protein, 396 aa, Ruegeria scottomollicae DSM 25328
MSFQNPVFIPGPTNIPESLRKACDMPTIDHRSPLFGQILHPAREGVRKVLKSTSAEVFIFPSSGTGGWETALSNTLSAGDTVLAARNGMFSHRWIDMCQRHGLDVQIVETPWGEGLPADRYEEILSADKGHKIKAVLATHNETATGVKSDIAAVRRALDAAGHPALLFVDGVSSIASMDFRMDEWGVDVAVTGSQKGFMLSAGLAIVGFSPKAMEATKTAQLPRTFFDVHDMAKGYANNAYPYTPAVGLMNGLNESCKMLLTEGLENVFARHHRIAEGVRAAVGAWGLELCAASPEVYSDTVSAIRTPEGFNATDIVTHAADKYGVAFGVGLGEVAGKVFRIGHLGSLTDVMALSGIATAEMCMVDLGLDIQLGSGVAAAQDYYRGNAASAQQDAA

SEQ ID NO: 554 - protein, 396 aa, Rhizobium leguminosarum CGMCC 1.2553T
MYTQNPVFIPGPTNMPEVLRRATDLPTIDHRSAAFADILQPALAGVRKVVKSENAEIVVFPATGSGGWEATITNLLSPGDKVLAARSGMFSHRWIDMCQRHGLQVDAVHSSWKQPLPLAEYEKRLVADKGHEIKAVLVTHNETATGVKSDVGAVRRLLDDARHPALLLVDGVSSIASMDFRMDEWKIDAAITGSQKGFMLPVGLAILALSPKAMQATQSAKLHRAFFDIREMAKAYPSSGYPYTPSVGLLNGLKVSTELLLEEGLDNVFKRHARIASGVRAAISAWGLHLYAQEASSYSDTVSAVETPEGFDATSIVTHAAQKYAVAFGAGLGDVAGRVFRIGHLGSMSDVMALSGIATAEMAMADLGLPIRLGSGVAAAQEVYRNTEASPVRNAA

SEQ ID NO: 555 - protein, 300 aa, Sulfitobacter sp. HI0021
MCQRHGLAVQTVETAWGAGIPADRYEEILTADKSHEIKAVLATHNETATGVKSDIAAVRRALDASGHPAMLLVDGVSSIASMDFRFDEWGVDVAVTGSQKGFMLPAGLAIVGFSPKAMEATKTASLPRTFFDVHDMAKGYANNAYPYTPAVGLLNGLNQACNMLLTEGLENVFARHFRIAEGVRAAVGAWGLELCATDPSVYSDTVSAIRTPEDFNATDIVTHAANKYGVAFGVGLGEVAGKVFRIGHLGSLTDVMALSGIATAEMCMVDLGLDIKLGSGVAAAQEYYRGHTAAAQKDAA

SEQ ID NO: 556 - protein, 300 aa, Sulfitobacter sp. HI0076; identical to SEQ ID NO: 555

SEQ ID NO: 557 - protein, 396 aa, Thalassobius mediterraneus CECT 5118; identical to SEQ ID NO: 397

SEQ ID NO: 558 - protein, 396 aa, Rhodobacteriaceae sp. PT6CLA
  MISC_FEATURE (1)..(396): uncultured Rhodobacteriaceae sp. PT6CLA
MSDQNPLFIPGPTNMPDRLRHAMQVQTRDHRAPDFVETLMPVLDGCKTVFGTAEGSVITFPASGTGGWEAAITNTLSPGDTVLIARYGMFSHRWIDMCERHGLDVRIIECDWGSGAPADKFEEALKADSIHAIKAVLVTHNETATGVKSDIAAVRAAMDSASHPALLLVDCVSSLASMPFEMDAWGVDIAVAGSQKGFMLATGMAILAVSQKALAAMDGATLPRTFFDFRDMLQANSTGGFPYTPPLQLIHGMRESLSMLFEEGLDNVYARHHRLAEGVRQATRAWGLDLVAQSPELYSDTVSAIYVPDGFDSNVLTDHAFNAYGVSFGVGLGQMNGKAFRIGHLGALTDVMVLSGLATIEMAMADLNYPIELGVGVSAAQEYFRQSWDTALKSAA

SEQ ID NO: 559 - protein, 396 aa, Sinorhizobium terangae WSM1721
MSGYNHLFIPGPTNIPEQVRQAMNLPMEDMRSPQYPELTLPLFADVKKVFKNRNGRVFIYPSSGTGAWEAAMTNVLSPGDRVLMSRFGQFSHLWVDMAERLGFEVDCLDMEWGTGVPVELYAERLAADKAHRIKAVFVTHNETATGVTSDVAAARAALDACGHPALLFVDGVSSIGSIDFRQDEWGVDCAVSGSQKGFMLPAGLGFLSVSEKALEAAKTARHMRCYFSFDDMIKTNDTGYFPYTPPTQLLRGLRAALDLMFAEGLENIFARHHHLANGVRAAVSAWGLKLCATEPKWHSDTVSAIRLPEGVDGVEVIRHAYRTYNTSLGSGLSKIAGKVFRIGHLGSLNEVMVLGALGAAELTLLDCGVKIEPGSGVGAAVKQFRSVTRTSTAKAA

SEQ ID NO: 560 - protein, 396 aa, Sinorhizobium terangae WSM1721
MYLQNPVFIPGPTNMPEVLRKASDMPTIDHRSPLFGEILRPALAGVKKVVKSQSASIFVFPATGTGGWETAITNTLSPGDRVLVARYGMFSHRWIDMCQRHGLDVGVIETPWGSGAPVDRYEEMLTADKAHQIKAVLVTHNETATGVKSDIAALRRALDAARHPAMLFVDGVSSIASMEFRMDDWGVDVAVTGSQKGFMLPAGLAITAFSPKALAALETAKLPRTFFDVRDMSKSYENNAYPYTPAVGLLNGLKVSTEMLLAEGLENVFARHNRIATGIRAAVRAWGLELCAMSEDLYSDTVSAIRTPDGFDATSVVTHAAKKYDVAFGVGLGEVAGKVFRIGHLGSLTDVMALSGVATAEMVMADLGLAIKLGSGVAAAQDYYRNNQVSAGRGAA

SEQ ID NO: 561 - protein, 396 aa, Ruegeria sp. TW15; identical to SEQ ID NO: 480

SEQ ID NO: 562 - protein, 396 aa, Rhizobium sp. BR816
MPGYNHLFIPGPTNIPEQVRQAMNLPMEDMRSPRYPELTLPLFADVKKVFKNQDGRVFIYPSSGTGAWEAAMTNVLSPGDRLLMSRFGQFSHLWVDMAERLGFEVDCLDREWGTGVPVELYAERLAADKAHEIKAVFVTHNETATGVTSDVAAVRAALDACGHPALLFVDGVSSIGSIDFRQDEWGVDCAVSGSQKGFMLPAGLGFLSVSQKALEAAKTARHMRCYFSFDDMIKTNDTGYFPYTPPTQLLRGLRAALDLIFEEGLENIFARHHHLANGVRAGVSAWGLKLCATEPKWHSDTVSAIRLPEGIDGAEVIRHAYRTYNTSLGSGLSKVAGKVFRIGHLGSLNEVMVLGALSAAELTLLDCGVAIEPGSGVGAAIKQFRSAAATATAKAA

SEQ ID NO: 563 - protein, 396 aa, Rhizobium sp. BR816
MYLQNPVFIPGPTNLPEVLRKASDMPTIDHRSPLFGEILRPALAGVKKVVKSEAASIFVFPATGTGGWETAITNTLSPGDRVLVARYGMFSHRWIDMCKRHGLDVSVIETPWGSGAPVDRYEEMLTADKAHQIKAVLVTHNETATGVKSDIAAVRHALDSARHPAMLFVDGVSSIASMEFRMDDWGVDVAVTGSQKGFMLPAGLAITAFSPKALAALETAKLPRTFFDVRDMSKSYENNAYPYTPAVGLLNGLKVSTEMLLAEGLENVFARHNRIAAGIRAAVRAWGLELCASSEDLYSDTVSAIRTPDGFDATSVVTHAAKKYDVAFGVGLGEVAGKVFRIGHLGSLTDVMALSGIATAEMVMADLGLGIKLGSGVAAAQEYYRKNQVSGDRGAA

SEQ ID NO: 564 - protein, 389 aa, Glaciecola sp. ANT9081 (cola82)
MSDQNPVFIPGPTNIPSRLLNAMHVQTRDHRSPDFVATLAPVISDLKRVFGTDSGNVITFPSTGTGGWEAAICNTLSPGDKVLIARYGMFSHRWIDLCQRHGLNVEIIECSWGSGAPADQFETRLKADSAAEIKAVLVTHNETATGVLSDIKAVREAMNNANHPAMLYVDCVSSLGCMPFEMDAWGVDVAISGSQKGFMLPTGMAILAVSPKALAAMETAKLPRTFFDFCDMMAANTNGGFPYTPPLQLIYGLKESLAMIFEEGLENVYARHFRLAEGVRKAVAAWGLTLCANSPDLYSQTVTAIYVPEGFDSNQLTDHAFRTYGVSFGIGLGEMNTKAFRIGHLGSLTDVMVLSGLATIEMSMADLKYPIKLGAGVVAAQEYFRKTAN

SEQ ID NO: 565 - protein, 396 aa, Paracoccus pantotrophus J40; identical to SEQ ID NO: 408

SEQ ID NO: 566 - protein, 396 aa, Marinovum algicola DG 898; identical to SEQ ID NO: 531

SEQ ID NO: 567 - protein, 396 aa, Labrenzia alexandrii DFL-11
MSFQNPVFIPGPTNMPDALRKACDMPTLDHRSPLFGEILQPALSGVKKILKSELAEVFIFPSTGTGGWETVITNTLSPGDKILAARNGMFSHRWIDLCQRHGLDVVIVDTPWGTGLPADRYEEILAADTHHEIKAVLATHNETATGVKSDIAAVRRALNNAKHPALLYVDGVSSIASMDFRMDEWGVDAAVTGSQKGFMLPAGLAIVGLSPKAQAAVDQGKLPRTFFDIRDMRKSYAVNAYPYTPAVGLLNGLKHSCDMLLSEGLDNVFARHHRIAEGVRAAVHAWGLQLCAGSRDVYSDTVSAIRTPEGFNATDIITHAAGKYGVAFGVGLGEVAGKVFRIGHLGSLTDVMTLSGLATAEMVMADLGLSIKLGSGVAAAQDYYRTEEAVSSKEAA

SEQ ID NO: 568 - protein, 395 aa, Methylobacterium sp. 285MFTsu5.1
MSGQNPTFIPGPTNIPEVLRKAVDMPTIDHRSPIFGDILRPALEGVRRVLKTTQAEVFVFPSTGTGGWEAAITNVLSPGDRVLATRNGMFSHRWIDMCHRHGLDVQVVEQSWGEGIPADRYEEILTADRGHTIKVVLATHNETATGVRSDIAAVRRALDAAKHPALLFVDGVSSIGCMDFRMDDWHVDVAVAGSQKGFMLPAGLAIVACSQRAAQAAEHAQLPRTFFDIRDMRGSYGNGRFPYTPPVGLLNGLKVASDLLLAEGLETVFARHHRIAEGVRRAVAAWGLTVCAARPELYSDTVTAILLPNGVDSDRFVGHAQDAYGVAFGTGLGQLAGKVFRIGHLGSLTDVMALSGIAAAEMVLADLGAAVELGAGVAAAQEYYRKGSAMAQLAA

SEQ ID NO: 569 - protein, 396 aa, Methylobacterium sp. 285MFTsu5.1; identical to SEQ ID NO: 528

SEQ ID NO: 570 - protein, 396 aa, Methylobacterium sp. EUR3 AL-11; identical to SEQ ID NO: 401

SEQ ID NO: 571 - protein, 396 aa, Paracoccus yeei ATCC BAA-599
MTSQNPIFIPGPTNIPEEMRKAVDMPTIDHRSPVFGRMLHPALEGVKKVLKTTQAQVFLFPSTGTGGWETAITNTLSPGDKVLAARNGMFSHRWIDMCQRHGLDVQFVETPWGEGIPADRFEEILTADKAHDIKVVLATHNETATGVKSDIAAVRRALDAAGHPALLFVDGVSSIGSMDFRMDEWGVDIAVTGSQKGFMLPPGLAIVGFSPKAMEAVETAKLPRTFFDIRDMATGYARNGYPYTPPVGLINGLNVACERLLNEGLENVFARHHRIAGGVRAAVDAWGMKLCAVRPALYSDSVSAIRVPEGFDANLIVSHALETYDMAFGTGLGEVAGKVFRIGHLGSLTDAMALSGIATAEMVMADLGLPIKLGSGVAAAQEHYRQSTATAQKKAA

SEQ ID NO: 572 - protein, 396 aa, Defluviimonas sp. 20V17
MSFQNPVFIPGPTNIPESLRKACDMPTIDHRSPLFGQILHPAREGVRKVLKSESAEVFIFPSTGTGGWETALSNTLSAGDKVLAARHGMFSDRWIDMCRRHGLDVQVVETPWGEGLPADRFEEILTKDKGHEIKAVLATHNETATGVKSDIAAVRRALDQAGHPAMLFVDGVSSIASIDFRFDAWKVDVAVAGSQKGFMLPAGLAIVGFSEKAMDATRTSTLPRTFFDVNDMAKGYKNNGYPSTPAVGLLNGLNQACGMLLQEGLENVFARHHRIAQGVRAAVGAWGLELCAVDPSVYSDTVSAVRTPAGFNATDIVTHAAHKYGVAFGVGLGEVAGKVFRIGHLGSLTDVMALSGIATAEMCMADLGLKIELGSGVAAAQDYYRGHAAVARKDAA

SEQ ID NO: 573 - protein, 396 aa, Sphingomonas sp. DC-6
MSTQNPVFIPGPTNIPEVLRKAVDMPTIDHRSPLFGKILHPALEGVKKVLKTREAQVFVFPATGTGGWETAITNVLSAGDKVLATRNGMFSHRWIDMCQRHGLDVQVVMQEWGEGVPSDRFEEILAADKEHQIKVVLATHNETATGVRSDIAAVRHALDRTKHPALLFVDGVSSIGCYDFRMDDWGVDVAVTGSQKGFMLPPGLAIVGFSPKALQAVETATLPRTFFDIRDMAKGYAANGFPYTPPVGLLNGLKVATDMLLEEGLDNVFARHHRIAEGVRQAVAAWGLKLCAARPELYSDSVSAIRVPEGFDANKIVSHALNTYGVAFGTGLGDVAGKVFRIGHLGSLTDVMALSGIATAEMVMVDLGLPVTLGSGVAAAQDYYRQSANAAQKKAA

SEQ ID NO: 574 - protein, 396 aa, Rhodobacteraceae bacterium bin18
  MISC_FEATURE (1)..(396): Alphaproteobacteria (AP)
MSFQNPVFIPGPTNMPEALRRACDMPTLDHRSAAFADILQPAREGVRRILRSATAEVFIFPATGTGGWEVAITNTLSRGDTVLAARNGMFSHRWIDMCQRHGLTVEIVETPWGEGIPADRFEEILRADTDGRIKAVLATHNETATGVLSDIAAVRAAMDAAGHDALLFVDGVSSIASMPFEFDTWGVDVAVTGSQKGFMLPAGLAITGFSSRALAAVETGGLPRCFYDIRDMAKSYAANGYPYTPAVGLLNGLAQSCEMILTEGLDAVFARHARIAGGVRAAVTAWGLDLCAARPELYSNSVSAIRTPEGFDATRIVTHAADTYGVAFGVGLGEVAGKVFRIGHLGMLTDVLALSGIATAEMAMADLGLDIKLGSGVAAAQEVYRSTAAPMALAAE

SEQ ID NO: 575 - protein, 396 aa, Paracoccus sulfuroxidans CGMCC 1.5364
MTSQNPIFIPGPTNIPEALRKAVDMPTIDHRSPVFGRMLHPALEGVKKVLKTTKGEIFLFPSTGTGGWETAITNTLSAGDKVLAARNGMFSHRWIDMCQRHGLDVTFVETPWGEGIPADRFEEILTADKGHEIRVVLATHNETATGVRSDIAAVRRALDNAKHPAMLFVDGVSSIGSMDFRMDEWGVDVAITGSQKGFMLPPGLAITGFSPKAMEAVESARLPRTFFDIRDMATGYARNGYPYTPPVGLINGLNHAVTMLMDEGLENVFARHNRIASGVRAAVKAWGLELCARRPELYSDTVSAILVPEGFDANKIVSRALETYDMAFGTGLGQVAGKVFRIGHLGSLTDAMALSGLAVAEMVMADEGLPIQLGSGVAAAQDVYRNAAKAAQKKAA

SEQ ID NO: 576 - protein, 392 aa, Marinobacterium sp. AK27
MSDQNPVFIPGPTNIPDRLLNAMHMQTRDHRAPDFVETFAPVLEDCKHVFGTETGQVITFPASGTGGWEASITNTLSAGDTVLVARYGMFSHRWIDMCQRHGLEVQVIDCEWGSGAPADKFEQALRADKDKKIKVVLATHNETATGVKSDIAAVRRAMDAAGHPAMLFVDCVSSLASMPFEMDAWGVDIAVSGSQKGFMLSTGMAILGVSQKALAAMESATLPRTFFDFRDMMAANANGGFPYTPPLQLIYGMRESLKMLFEEGLENVYARHHRLAEGVRRAVEAWGLKLCAKSPELYSDTVSAIYVPEGFDSNKLTEHAFNTYGVSFGIGLGQMNGKAFRIGHLGMLTDVMCLSGLATIEMAMADLNYPVELGSGVRAAQEYYRATAAANQ

SEQ ID NO: 577 - protein, 396 aa, Yangia pacifica DSM 26894
MSFQNPVFIPGPTNIPESLRKACDMPTIDHRSPLFGQILHPAREGVRHVLKSASAEVFIFPSTGTGGWETALTNTLSPGDTVLAARNGMFSHRWIDMCQRHGLTVEVVETPWGEGLPAQRYAEILAADKSRRIKAVLATHNETATGVRSDIAAVRRALDEADHPALLFVDGVSSIASMDFRFDDWGVDCAVTGSQKGFMLPPGLAIVGFSEKAMAATKTAKLPRTFFDVTDMAKGYANNAYPYTPAVGLLNGLNESCRMLLDEGLENVFARHHRIAEGVRAAVRAWGLELCAASPEVYSDTVSAIRTPEGFNATDIVSHAAQTYGVAFGTGLGEVAGKVFRIGHLGSLTDVMTLSGLACAEMCMKDLGLDIALGSGVAAAQDFYRANPALARKEAA

SEQ ID NO: 578 - protein, 396 aa, Shimia haliotis DSM 28453
MSFQNPVFIPGPTNIPESLRKACDMPTIDHRSPLFGQILHPARKGVREILKSVDAEVFIFPSTGTGGWETALTNCLSAGDKILAARNGMFSHRWIDMCERHGLDVQIVETPWGEGLPADRYEEILTADTQHQIKAVLATHNETATGVKSDIAAVRRALDAAGHPAMLFVDGVSSIASMDFRMDEWGVDVAVTGSQKGFMLTAGLAIVGFSPKAIAATKSATLPRTFFDINDMTAGYANNAYPYTPAVGLLNGLNEACTMLLNEGLENVFARHHRIAEGVRAAVGAWGLDLCAADPSVYSDTVSAIRTPDGFNATDIVTHAASKYGVAFGVGLGEVAGKVFRIGHLGSLTDVMALAGIATAEMCMADLGLDIKLGSGVAAAQDYYRGHSAVSQKDAA

SEQ ID NO: 579 - protein, 394 aa, Hasllibacter halocynthiae DSM 29318
MSFQNPVFIPGPTNMPEDLRRACDMPTLDHRSPLFGEILHPALEGVAKVVGTKKGEVFVFPATGTAGWEVALTNTLSPGDKVLATRNGMFSHRWIDMCERHGLDVTVIRREWGEGIDAAAVEEALRADPAIKAVLATHNETATGVVSDIAAVRRAMDAAGSDALLFVDGVSSIASMPFHFDDWGVDVAITGSQKGFMLPPGLAITVFSAKAADAVEGAGLPRTFLDIRDMRKGYAAGGFPYTPPVGLLNGLNLSCRRLLDEGMKGVWARHHHIAEGVRAAVEAWGLELCAVSPELYSDTVSAIRTPEGFDANRLVAHAATRYGVAFGTGLGEVAGKVFRIGHLGSLTEPMALAGIATAEMAMRDLGLEVESGSGTAAAEEVYRGAGAPMAMAAE

SEQ ID NO: 580 - protein, 397 aa, Oceanicola nitratireducens DSM 29619; identical to SEQ ID NO: 467

SEQ ID NO: 581 - protein, 396 aa, Ruegeria halocynthiae DSM 27839
MSNQNPVFIPGPTNIPDRLRLAMQVQTQDHRAPDFVETFAPVLEDTKKIFGAAEGQIVTFPASGTGGWEAAVTNTLSPGDKVLVARYGVFSHRWIDLCERHGLDVQVVECPWGTGAPADRFEAILSADNAHEIKAVLVTHNETATGVRSDISAVRHAMNAATHPAMMFVDCVSSLASMPFEFDQWGVDIAVSGSQKGFMLATGMAILCVSPKALAAMKTANLPRTFFDFRDMMAANASGGFPYTPPLQLIYGMRESLKMLFEEGLENVYARHTRLAEGVRRAVDAWGLKLVAQSPDLYSETVSAIIVPEGFDSNELTDHAFNTYGVSFGIGLGELNGKAFRIGHLGSLTDVMALSGLATIEMAMADLNYPVELGSGVAAAQEFYRAGSSSHAQAAA

SEQ ID NO: 582 - protein, 396 aa, Citreimonas salinaria DSM 26880
MSLQNPVFIPGPTNIPDAIRKACDMPTMDHRSAAFADILHPALNGARQVMGQSTGETFVFPSTGTGGWETAIANTLSPGDRVLAARNGMFSHKWIDMCQRFGLQVTQIDVEWGEGVPTAAFEEALRADTGGGIKAVLATHNETATGVVSDIAGVRRALDAAGHGALLLVDGVSSIGSMPFDFDGWGVDVAVTGSQKGFMLPVGLAIVGFSDKAVAASQTATLPRTFFSIDDMRKGYAANGYPYTPAVGLLNGLKLSTAMLLDEGLENVFARHARIASGVRAAVAAWGLELCAKSPELYSNTVTAVRTPEGFDASRIVETASRDYGMAFGTGLGDVAGKVFRIGHLGSMTDAMALSGIATAEMVMADLGLDITLGAGVAAAQSVYRHGAQTERMAAQ

SEQ ID NO: 583 - protein, 396 aa, Ruegeria mobilis S1942
MSFQNPVFIPGPTNIPESLRKACDMPTIDHRSPLFGQILHPARDGVRKVLKSTSAEVFIFPSSGTGGWETALSNTLSAGDTVLAARNGMFSHRWIDMCQRHGLDVQIVETPWGAGLPADRYEEILSADKAHKIKAVLATHNETATGVKSDIAAVRRALDAAGHPALLFVDGVSSIASMDFRMDEWGVDVAVTGSQKGFMLSAGLAIVGFSPKAMEATKTAQLPRTFFDVHDMAKGYANNAYPYTPAVGLMNGLNESCKMLLAEGLENVFARHHRIAEGVRAAVGAWGLELCAASPEVYSDTVSAIRTPEGFNATDIVTHAADKYGVAFGVGLGEVAGKVFRIGHLGSLTDVMALSGIATAEMCMVDLGLDIRLGSGVAAAQEYYRGNAASAQQDAA

SEQ ID NO: 584 - protein, 396 aa, Leisingera aquaemixtae CECT 8399
MSFQNPVFIPGPTNMPEALRKAVDMPTLDHRSPLFGQILHPALAGVKKVLKSETAEIFVFPSTGTGGWETAITNTLNAGDKILAARNGMFSHRWIDMCQRHGLDVQIVETPWGEGLPADRYEEILTADTAHEIKVVLATHNETATGVKSDIAAVRRALDAAGHPALLFVDGVSSIASMDFRMDEWGVDIAVTGSQKGFMLPPGLAIVGFSPKAMKAAETATLPRTFFDIKDMANGYANSAYPYTPSVGLLNGLNMACGMLLDEGLENVFARHHRIAEGVRAAVRAWGLELCAVSPEVYSDSVSAIRTPDGFDANTFVSLAAEKYGVAFGTGLGEVAGKVFRIGHLGSLTDVMTLSGIATAEMVMADLGLNIKLGSGVAAAQDYYRVNSASSAKAAA

SEQ ID NO: 585 - protein, 396 aa, Leisingera aquaemixtae CECT 8399
MSFQNPVFIPGPTNMPEALRKAVDMPTLDHRSPLFGQILHPALAGVKKVLKSETAEIFVFPSTGTGGWETAITNTLNAGDKILAARNGMFSHRWIDMCQRHGLDVQIVETPWGEGLPADRYEEILTADTAHEIKVVLATHNETATGVKSDIAAVRRALDAAGHPALLFVDGVSSIASMDFRMDEWGVDIAVTGSQKGFMLPPGLAIVGFSPKAMKAAETATLPRTFFDIKDMANGYANSAYPYTPSVGLLNGLNMACGMLLDEGLENVFARHHRIAEGVRAAVRAWGLELCAVSPEVYSDSVSAIRTPDGFDANTFVSLAAEKYGVAFGTGLGEVAGKVFRIGHLGSLTDVMTLSGIATAEMVMADLGLNIKLGSGVAAAQDYYRGNSASSAKAAA

SEQ ID NO: 586 - protein, 396 aa, Paracoccus halophilus JCM 14014; identical to SEQ ID NO: 461

SEQ ID NO: 587 - protein, 396 aa, Ruegeria sp. ZGT118
MSFQNPVFIPGPTNIPESLRKACDMPTIDHRSPLFGQILHPAREGVRKVLKSDSAEIFIFPSTGTGGWETALTNTLSAGDTVLAARNGMFSHRWIDMCQRHGLKVDIVETAWGEGLPADRYAEILAADTAHEIRAVLATHNETATGVKSDIAAVRRALDAAGHPAMLFVDGVSSIASMDFRFDEWGVDVAVTGSQKGFMLPAGLAIVGFSRKAMDATRTGTLPRTFFDVHDMAKGYASNAYPYTPAVGLLNGLNQACDLLLREGLENVFARHHRIAEGVRAAVRAWGLDLCAVDPSVYSDTVSAIRTPEGFNATDIVTHAAEKYGVAFGVGLGEVAGKVFRIGHLGSLTDVMALSGIATAEMCMADLGLDIKLGSGVAAAQDYYRGHPAEAHKDAA

SEQ ID NO: 588 - protein, 396 aa, Ruegeria faecimaris DSM 28009
MSNQNPVFIPGPTNIPDRLRLAMQVQTQDHRAPDFVQTFAPVLEDTKKVFDTATAQIVTFPASGTGGWEAAITNTLSPGDKVLIARYGVFSHRWIDLCTRHGLDVQVIDCPWGSGAPADQFQTVLTGDKAHEIRAVLVTHNETATGVLSDIGAVRRAMDAANHPALLMVDCVSSLASVPFEFDRWGVDIAVSGSQKGFMLATGMAILCVSQKALDAMETAELHRTFFDFRDMMAANATGGFPYTPPLQLIYGLRESLKMLFEEGLPNVYARHHRLAEGVRRAVDAWGLELVAQSPDLYSDTVSAIYVPEGFDSNILTDHAFNTYGMSFGVGLGQLHGKAFRIGHLGSLTDAMVLSGLCTIEMAMADLSYPITLGSGVAAAQEHFRATPGNRTEAAA

SEQ ID NO: 589 - protein, 396 aa, Shimia sagamensis DSM 29734
MSFQNPVFIPGPTNIPESLRKACDMPTIDHRSPLFGQILHPAREGVRKVLKSESAEIFIFPSTGTGGWETALTNTLSAGDKILAARNGMFSHRWIDMCQRHNLDVQVVETPWGEGLPADRYEEILTADTNHEIKAVLATHNETATGVKSDIAAVRRALDAAGHPALLFVDGVSSIASMDFRMDEWGVDVAVTGSQKGFMLTAGLAIVGFSAKAMAATETAKLPRTFFDVHDMAKGYAANAYPYTPAVGLLNGLNEACTMLLNEGLENVFARHTRIAEGVRAAVGAWGLELCAANPSVYSDTVSAIKTPEGFNATDIVTHAAEKYGVAFGVGLGEVAGKVFRIGHLGSLTDVMALSGIATAEMCMVDLGLDIKLGSGVAAAQDYYRGNTATAQKDAA

SEQ ID NO: 590 - protein, 300 aa, Sulfitobacter sp. HI0027; identical to SEQ ID NO: 555

SEQ ID NO: 591 - protein, 391 aa, Psychrobacter cryohalolentis K5
MSLQNPIFIPGPTNIPDRLRRAMNVPTQDHRAPDFSDTFLPVLADCKKVFGTQDGEIILFTSSGTGGWEAAISNTLSPGDKVLIARYGMFSHRWIDMCQRHGLDVQVVECDWGTGAPADKFQAILNEDTAHEIKAVMVTHNETATGVLSDIGAVRKAMDSSDHPALLFVDGVSSIACVPFEMDAWGVDVAVAGSQKGFMLATGMAILGVSQKALSHMDEAKLPRTYFAFRDMLNANANGGFPYTPPLNLIYGLRESLEMLFDEGLDNVYARHYRLAEGVRQAVSAWGMKLCAKTPDLYSNTVSAIFVPEGFDSNKLTDHAFNKYGISFGIGLGEMNGKAFRIGHLGSLTEVMVLAGLATIEMAMVDLGYPIKLGQGVAAAQEYYRHSAPTK

SEQ ID NO: 592 - protein, 396 aa, Rhodobacterales bacterium Y4I; identical to SEQ ID NO: 373
  MISC_FEATURE (1)..(396): scf_1106129324775 genomic scaffold

SEQ ID NO: 593 - protein, 396 aa, Artificial Sequence
  synthetic peptide
  MISC_FEATURE (1)..(396): cNanh_4411
MSFQNPVFIPGPTNMPEAVRQACYMPTIDHRSPVFGKILHPCLEGVQKVLKSDSARIFIFPSTGTGGWETALTNALSAGDGVLAARNGMFSHRWIDMCQRHGLDVTIVETPWGHGLPADRYEEILRADTGHRIKAVLATHNETATGVRSDIAAVRRALDAAGHPAMLFVDGVSSIGSMDFRFDEWGVDVAVTGSQKGFMLPAGLAIVGFSDKAMAAVETTTLPRTFFDIRDMAKGYAANAFPYTPPVGLMNGLKLSLDMLLSEGLENVFARHHRIAEGVRRAVGAWGLDLCAASPDLYSDSVSAIRTPEGFNATDIVTRAANEYGMAFGVGLGEVAGKVFRIGHLGSLTDAMMLSGLGVAEMVMVDLGLEVRLGSGVAAAQDYYRHGSGKTNKAAA

SEQ ID NO: 594 - protein, 396 aa, Methylobacterium mesophilicum SR1.6/6
MFAQNPVFIPGPTNMPEVLRRAADMPTLDHRSPLFAQILHPALAGVKTVLKSEDAEVFIFPSTATGGWETALSNTLSAGDTVLAARHGMFSHRWIDMTRRHGLDVRMIEAPWGEGVPADRFAEALAADTAHRIRAVLVTHNETATGVRSDVAAVRRALDASNHPALLLVDGVSSIASMDFRMDAWGVDVAVTGSQKGFMLPAGLAIVAFSPKAMAATATATLPRTYFDIRDMAKGYPNGAYPYTPAVGLLNGLKLSTELLLAEGLENVFARHRRIADGIRAAVAAWGLELCAARPDLYSDTVSAIRTPEGFDATRIVTHAARHYDVAFGVGLGEVAGKVFRIGHLGSLTDVMALSGIAAAEMAMADLGLRIELGSGVAAAQAVYRRAPAAALRAAA

SEQ ID NO: 595 - protein, 396 aa, Methylobacterium sp. B34; identical to SEQ ID NO: 528

SEQ ID NO: 596 - protein, 400 aa, Roseivivax halodurans JCM 10272
MRTGQTHLFIPGPTNIPESVRQAMNVPMQDMRAPDFGALTLGLFDGLRRVMRSASAEVFLFPGSGTGAWEAAITNTLNPGDKVLMSRHGQFSTLWVEMAERLGLDVEVIDVPWGQGVPVAEFERRLGEDREDAIKAVFVTHNETATGVTSDVAGVRRALDETFHDALLFVDGVSSIASIDFRMDEWGVDLAVTGSQKGLMCPAGLGILAVSEKAMDASTRSTMRRAYFEFSDMRKMNADGYFPYTPPTQILHGLAKSLARIEAEGLDAVIARHHRLAEGVRRGVSAWGLDLVAAEPALYSDTVSAIRVPEAVDAREVIRIAYEEYNTSFGTGLAQLAGKVFRIGHLGDLNEGMCLSALGIAEMALARSGVRLQLGSGVAAAQAFYAFGTEARERIALAAE

SEQ ID NO: 597 - protein, 395 aa, Roseivivax halodurans JCM 10272
MHFQNPVFIPGPTNIPERLRRACDLPTIDHRSPRFGDILHPAREGVRRVMKSETAEIFLFPASGTGGWEAAITNTLSAGDRVLVSRYGMFSHRWIDLCQRHGLDVTIIDAPWGDALPVERCAEVLAADKSHEYKAVLATHNETATGVRSDIAGLRRAMDGAGHPALLMVDGVSSIASMDFRFDEWRVDVAVTGSQKGFMLPPGLAILGFSQKAMAASKEARLSRTYFDVHDMAKGYAQNAYPYTPTPGLLNGLAMACDMLLDEGLENVFARHHLIAEGVRAAVRAWGLELCATAPEISSDTVSAIRTPEGFDASRIVAHAAQTYDVAFGAGLGEVAGKVFRIGHLGSLTDVMALAGLATAEMCMVDLGLDIRLGSGVAAAQEFYRTEQGLRAVAA

SEQ ID NO: 598 - protein, 411 aa, Pelagicola litoralis DSM 18290
MLRASFVEKFKKGAVMSFQNPVFIPGPTNMPEGLRKAVDMPTLDHRSSLFADILHPALAGVKKVLKSETAEVFIFPSTGTGGWETALTNTLSAGDKVLAARNGMFSHRWIDMCTRHGLDMTVVDAPWGAGIPLDRYEDILRKDVNHEIKVVLATHNETATGVRSDIAGVRRAMDAAGHPALLYVDGVSSIGSMDFQMDAWGVDIAVTGSQKGFMLPAGLAIVAFSPKAVARTETAGLARTFFDVRDMAAGYANNAYPYTPAVGLLNGLKTSTEMLLEEGLEAVFARHTRIANGVRAAVDAWGLALCAASPDLYSDTVSAIVTPQGFNATDIVTHAADVYDVAFGVGLGDVAGKVFRIGHLGSMTDVMALAGIATAEMCMVDLGLDIQLGAGVAAAQESYRASTADARRAAA

SEQ ID NO: 599 - protein, 396 aa, Thalassobacter stenotrophicus DSM 16310
MISQNPVFIPGPTNMPEVLRKSCDMPTLDHRSAAFAGILHPALEGVKKVLKTTSAEVFVFPSTGTGGWETALTNTLSPGDTVLVGRNGMFSHRWIDMCERHGLDVIVLDTAWGQGLPVDRYGEVLAQDTEHRIKAVLATHNETATGVVSDIAGLRAAMDASDHPALLLVDGVSSIGSMNFEMDAWGVDIAVTGSQKGFMLPAGLAIVGVSQRALGAMATAKLPRTFFDLRDMQKGYAVNGYPYTPPVGLLNGLKLACDMLLEEGLENVFARHRRIADGVRAAVAAWGLELCAERPEWQSDTVSAVRTPEGFDAGEIVTHAAEVYDMAFGVGMGEVAGKVFRIGHLGMLTEAQALCGLATVEMCMVDLGLDIQLGSGVAAAQGVYRHGTRQQAMAAE

SEQ ID NO: 600 - protein, 396 aa, Methylobacterium sp. UNC300MFChir4.1
MFAQNPVFIPGPTNMPEVLRRAADMPTLDHRSPLFAQILHPALAGVKKVLKSEDAEVFIFPSTATGGWETALSNTLSAGDTVLAARHGMFSHRWIDMTRRHGLDVRVIEAPWGEGLPADRFAEALAADKAHRIRAVLVTHNETATGVRSDVAAVRRALDASNHPALLLVDGVSSIASMDFRMDAWGVDVAVTGSQKGFMLPAGLAIVAFSPKALAATATATLPRTYFDIRDMAKGYPNGAYPYTPAVGLLNGLKLSTELLLAEGLETVFARHRRIADGIRAAVAAWGLELCAARPDLYSDTVSAIRTPEGFDATRIVTHAARHYDVAFGVGLGEVAGKVFRIGHLGSLTDVMALSGIAAAEMAMADLGLRIALGSGVAAAQAVYRRAPAAALRAAA

SEQ ID NO: 601 - protein, 396 aa, Paracoccus pantotrophus DSM 1403; identical to SEQ ID NO: 532

SEQ ID NO: 602 - protein, 396 aa, Rhizobium lusitanum P1-7; identical to SEQ ID NO: 458

SEQ ID NO: 603 - protein, 395 aa, Paracoccus alkenifer DSM 11593
MSTQNPIFIPGPTNIPELLRKAVDMPTIDHRSPLFGKILHPALAGVKQVLKSTRAEVFVFPATGTGGWETAITNTLSPGDKVLATRNGMFSHRWIDMCRRHGLDVQVVMQDWGEDVPAARFEEILTADTAHEIKVVLATHNETATGVRSDIAAVRRAMDAAGHPALLFVDGVSSIGCYDFRMDEWGVDVAVTGSQKGFMLPPGLAIVGFSPRAMAAVEMAALPRTFFDIRDMAKGYAVNGYPYTPPVGLLNGLKLATEMLLGEGLDNVFARHHRIAEGVRRAVAAWGMKPCAARPELYSDSVTAIRTPEGFDANRIVSRALDSYGVAFGTGLGDVAGKVFRIGHLGSLTDVMALSGIATAEMVMADLGLPVVLGSGVAAAQDHYRRTAPAAPATA

SEQ ID NO: 604 - protein, 396 aa, Loktanella koreensis DSM 17925
MSFQNPVFIPGPTNMPEDIRKACDMPTIDHRSPLFGQILHPARAGVQKVLKSDYAEIFIFPSTGTGGWETAITNTLSHGDKVLIARNGMFSHKWIDMCQRHKLEVEIVEVPWGQGIPADRYGDILAADTNHEIRAVLATHNETATGVKSDIAAIRAVMDACDHPALLLVDGVSSIGSMDFRFDEWKVDVAVTGSQKGFMLPAGLAIVGFSPKAMGATKTARLPRTFFDVHDMAKGYDNNAYPYTPAVGLMNGLKLACDKLLAEGLDNVFARHHRIASGVRAAVDAWGLDLCAVDASVYSDSVSAIVTPGGFNASDIVTLAAEKYGVAFGTGLGEVAGKVFRIGHLGSLTDVMALSGIATAEMCMVDLGLDITLGSGVAAAQEYYRGNAVKSLREAA

SEQ ID NO: 605 - protein, 395 aa, Methylobacterium sp. 190MF; identical to SEQ ID NO: 568

SEQ ID NO: 606 - protein, 396 aa, Methylobacterium sp. 190MF; identical to SEQ ID NO: 528

SEQ ID NO: 607 - protein, 396 aa, Ruegeria sp. ANG-S4
MSNQNPVFIPGPTNIPDRLRAAMQVQTQDHRAPDFVETFAPVLEDTKSVFGTQQGQVITFPSSGTGGWEAAITNTLSPGDKVLVARYGVFSHRWIDLCARHGLDVQVIECAWGDGAPAATFQSILADDVGREIRAVLVTHNETATGVYSDIAAVRQAIDAAGHPAMLFVDCVSSLASMPFEFDNWGVDVAVSGSQKGFMLAAGMAILCVSPKALAAMDAATLPRTYFDLADMMAANASGGFPYTPPLQLIYGMRESLRMLFEEGLDNVYARHFRLAEGVRRAVDAWGLKLVATSPKLYSDTVSAIYVPDGFDSNALTDHAFNTYGVSFGIGLGQLNGKAFRIGHLGSLTDVMVLSGLATIEMAMADLNYPIELGSGVAAAQDYFRSGSQGRAQAAA

SEQ ID NO: 608 - protein, 396 aa, Leisingera nanhaiensis CGMCC 1.10959; identical to SEQ ID NO: 593

SEQ ID NO: 609 - protein, 396 aa, Loktanella rosea DSM 29591
MSFQNPVFIPGPTNMPEAIRKACDMPTIDHRSPLFGQILHPARAGVQKILKSDTAEVFIFPSTGTGGWETALTNTLSPGDTVLAARNGMFSHRWIDMCQRHGLDMQIVETPWGQGIPADRYAEILKADTAHKIKVVLATHNETATGVKSDIAAVRKALDAAGHPAMLFVDGVSSIGSMDFRFDEWGVDVAVTGSQKGFMLPAGLAIVGFSQKALAASKTAKLPRTFFDIADMTKGYAANAYPYTPAVGLMNGLLLATEMLLKEGLENVFTRHNRIASGVRAAVDAWGLELCAETPDLYSDTVSAVKTPDGFNATDIVTLAAEKYGVAFGVGLGEVAGKVFRIGHLGSMTDVMALSGIATAEMCMVDLGLDIQLGSGVAAAQEYYRGSTGLKMRDAA

SEQ ID NO: 610 - protein, 396 aa, Poseidonocella pacifica DSM 29316
MSGFKGLAVPGPTNMPFEIRRAMDVALEDHRAPDFPDFIKPLLADLKKVFQTETGQVFVFPGSGTGGWESAIANTLAPGDTVLASIFGQFSYLWVDMCRKFGLNVDAIECEWGTGVPADLYEQKLAADKEHKIKAVLVTQNETATGVTSDVKAVREALDRTGHPALLFVDGVSSIGSIDFRQDEWGVDVAVSGSQKGFMLPTGLAIVGVSRKALAHRPEGGLPRCFFDYQDMAKTNADGFFPYTPATTLLRGLRASLDMIFDEGLENIFARHHRLAEGVRRAVDAWGMSLCAKEAKWNSDTVSAIVVPEGYNANDVIQTAYHKYDLSLGAGLSKVAGKVFRIGHLGYLNEIMVLQALGGAELAMRDVGLPFTPGVGVGAAVEYYAATGQAEALAAQ

SEQ ID NO: 611 - protein, 396 aa, Poseidonocella pacifica DSM 29316
MSDQNPVFIPGPTNIPDRLRMAMSMQTKDHRAPDFVETFAPVLEDTKRVFGTAEGEIILFPGSGTGGWEAAITNTLSPGDAVLIARYGMFSHKWIDMCERHGLDVRVVECPWGEGAPAERFGEILADDTAGEIKAVLVTHNETATGVMSDISLVRKAMDGANHDALLLVDCVSSLACVPFEMDAWGVDIAVSGSQKGFMLQTGMAILGVSQKALNTMEGAKLPRTYFDFRDMRKAYVGGGYPYTPPVQLIQGLRTSLDMLFEEGLGAVYDRHVRLAEGVRRAASAWGLSLCAARPELYSQTVSAIYVPSGFDSNALTEHAYRAYGVSFGVGLGEMNGKAFRIGHLGMLTDVMVLSGLATIEMAMADLGYPIELGSGVAAAQEHYRASRANALRSAA

SEQ ID NO: 612 - protein, 396 aa, Leisingera sp. ANG-S5
MSFQNPVFIPGPTNMPEALRKAVDMPTLDHRSPLFGQILHPALAGVKKVLKSETAEIFVFPSTGTGGWETAITNTLNSGDKILAARNGMFSHRWIDMCQRHGLDVQVVETPWGEGLPADRYEEILTADTSHQIKAVLATHNETATGVKSDIAAVRRALDAAGHPALLFVDGVSSIASMDFRMDEWGVDIAVTGSQKGFMLPPGLAIVGFSPKAMKAAETATLPRTFFDIKDMANGYANSAYPYTPSVGLLNGLNMACGMLLDEGLENVFARHHRIAEGVRAAVRAWGLELCAVSPDVYSDSVSAIRTPDGFDANKFVSLAAEKYGVAFGTGLGEVAGKVFRIGHLGSLTDVMALSGIATAEMVMADLGLNIQLGSGVAAAQDYYRGNTASSTKAAA

SEQ ID NO: 613 - protein, 396 aa, Cribrihabitans marinus DSM 29340
MSFQNPVFIPGPTNMPEALRKACDMPTIDHRSPLFGQILHPAREGVRKILKSDSAEIFIFPSTGTGGWETALTNTLSAGDKVLAARNGMFSHRWIDMCQRHGLKVEVVETPWGEGLPADRYEEILTADTGHEIKVVLATHNETATGVKSDIAAVRRALDAAGHPALLFVDGVSSIASMDFRFDEWGVDVAVTGSQKGFMLPAGLAIVGFSAKAMQATGTGTLPRTFFDVHDMAKGYANNAYPYTPAVGLLNGLNDACAMLLGEGLDNVFARHHRIAEGVRAAVRAWGLDLCARSPEVYSDTVSAIRTPEGFNATDIVTLAAEKYGVAYGTGLGEVAGKVFRIGHLGSLTDVMALSGIATAEMVMADLGLDIQLGSGVAAAQDVYRSPQPTHSRAAA

SEQ ID NO: 614 - protein, 396 aa, Ruegeria mobilis DSM 23403
MSFQNPVFIPGPTNIPESLRKACDMPTIDHRSPLFGQILHPARDGVRKVLKSETAEVFIFPSSGTGGWETALSNTLSAGDTVLAARNGMFSHRWIDMCQRHGLDVQIVETPWGAGLPADRYEEILSADKDHKIKAVLATHNETATGVKSDIAAVRRALDAAGHPALLFVDGVSSIASMDFRMDEWGVDVAVTGSQKGFMLSAGLAIVGFSPKAMEATKSAQLPRTFFDVHDMAKGYANNAYPYTPAVGLMNGLNESCKMLLAEGLENVFARHHRIAEGVRAAVGAWGLELCAATPEVYSDTVSAIRTPEGFNATDIVTHAADKYGIAFGVGLGEVAGKVFRIGHLGSLTDVMALSGIATAEMCMVDLGLDIRLGSGVAAAQEYYRGNAASAQQDAA

SEQ ID NO: 615 - protein, 396 aa, Pseudopelagicola gijangensis DSM 100564
MSFQNPVFIPGPTNMPEALRRAADMPTLDHRSSLFAEILHPALDGVKQVLKSKTAEVFVFPSTGTGGWETALTNTLSAGDKVLAARNGMFSHRWIDMCTRHGLDMQIVEAAWGAGVPTDRYEEILRADKNHEIKVVLATHNETATGVKSDIAGVRRALDNAGHPALLYVDGVSSIGSMDFRMDEWGVDIAVTGSQKGFMLPAGLAIIGFSPKAMAQVETATLPRTFFDIRDMAAGYANNAYPYTPAVGLLNGLKLATEMLLNEGLENVFTRHNRIANGVRAAVNAWGLTLCAQSPDLYSDSVSAIMTPEGFNATDIVSHAADVYGVAFGVGLGEVAGKVFRIGHLGSLTDVMALSGIATAEMCMVDIGLDIQLGSGVAAAQEVYRQTTGYTLKAAA

SEQ ID NO: 616 - protein, 396 aa, Ruegeria atlantica CECT 4293
MSNQNLVFIPGPTNIPDRLRLAMQVQTQDHRAPDFVETFAPVLEDTKKVFGTTTGQIVTFPSNGTGGWEAAVTNTLSPGDKVLVARYGVFSHRWIDLCERHGLDVQIVECPWGTGAPADQFQAALADDTAHEIRAVLVTHNETATGVRSDIAAVRQAMDSENHPAMLFVDCVSSLASMPFDFDAWGVDIAVSGSQKGFMLATGMAILCVSPKAQDAMKSAKLPRTFFDFDDMMAANASGGFPYTPPLQLIYGMRESLKMLFEEGLENVYARHFRLAEGVRRAVDAWGLKLVAQSRDLYSDTVSAIYVPDGYDSNTLTDHAFNAYGVSFGIGLGQLNGKAFRIGHLGSLTDVMVLSGLSTIEMAMADLNYPITLGSGVAAAQDYYRTGPSDRAQAAA

SEQ ID NO: 617 - protein, 396 aa, Thalassobacter stenotrophicus CECT 5294; identical to SEQ ID NO: 599

SEQ ID NO: 618 - protein, 396 aa, Loktanella sediminilitoris DSM 29955
MSFQNPVFIPGPTNIPENLRKACDMPTIDHRSPLFGTILHPARDGVRKVLKSDKAEVFIFPSTGTGGWETAVTNCLSSGDKVLAARNGMFSHRWIDLCQRHGLDVEIVEASWGAGIPVDRYEEILTADTSHQIKAVLATHNETATGVKSDIAAVRKALDAAGHPALLFVDGVSSIGSMDFRFDEWAIDVAVTGSQKGFMLPPGLAIVGFSEKAMAATKTGTLPRTFFDVHDMAKGYANNAYPYTPAVGLLNGLTEACGMLMAEGLENVFARHTRIAEGVRAAVDAWGLELCAETPDVYSDTVSAIRTPEGFNATDIVTHAAETYGVAFGVGLGDVAGKVFRIGHLGSLTDVMTLSGLATAEMCMVDLGLDIKLGAGVAAAQEYYRAHTAFAQKAAA

SEQ ID NO: 619 - protein, 396 aa, Rhizobium taibaishanense DSM 100021T
MYMQNPVFIPGPTNMPEVLRKASDMPTLDHRSPLFGEILRPALAGVKKVLKTETASVFVFPSTGTGGWETAITNTLSPGDRVLAARYGMFSHRWIDMCQRHGLKVDVIESVWGGGAPADRYEEILTADTGHEIKAVLVTHNETATGVKSDIGAIRQAIDAAKHPALLFVDGVSSIASMDFRMDGWAVDIAITGSQKGFMLPAGLAIAAFSAKALEALDSAKLPRTFFDVRDMTKSYANNAYPYTPAVGLLNGLKLSTELLLAEGLENVFARHRRIASGIRAAVRAWGLELCAKDEELYSDTVSAIRTPEGFDATSIVTHAARKYDVAFGVGLGEVAGKVFRIGHLGSLTDVMALSGIATAEMVMVDLGLEITLGSGVAAAQDHYRNVHLSAVQAAA

SEQ ID NO: 620 - protein, 396 aa, Rhodobacteraceae bacterium JGI 01_L11_4000m
  MISC_FEATURE: Contamination screened
MSFQNPVFIPGPTNIPESLRKACDMPTIDHRSPLFGQILHPARAGVRQILKSDNAEVFIFPSTGTGGWETALTNTLSPGDKVLAARNGMFSHRWIDMCQRHGLSVQVVETTWGAGLPADRYEEILTADKNHEIKAVLATHNETATGVKSDIAAVRRALDASGHPAMLFIDGVSSIASMDFRFDEWGVDVAVTGSQKGFMLPAGLAIVGFSPKAMEATKTATLPRTFFDVHDMAKGYANNAYPYTPAVGLLNGLNQACDMLLREGLENVFARHHRIAEGVRAAVGAWGLDLCATDPSVYSDTVSAIRTPEGFNATDIVTHAANRYGVAFGVGLGEVAGKVFRIGHLGSLTDVMALSGIATAEMCMVDLGLNIELGSGVAAAQEYYRGHSAAAQKDAA

SEQ ID NO: 621 - protein, 396 aa, Sulfitobacter sp. HI0054; identical to SEQ ID NO: 620

SEQ ID NO: 622 - protein, 396 aa, Labrenzia aggregata CECT 4801
MSFQNPVFIPGPTNMPEALRRACDMPTLDHRSPLFGQILQPALAGVKKVLKTETAEVFLFPSTGTGGWETAITNCLSPGDKILAARNGMFSHRWIDMCQRHGLKVEVVEAAWGTGLPADRYEEILAADTNHEIKAVLATHNETATGVKSDIAAVRRALNAAKHPALLFVDGVSSIASMDFRMEEWGVDAAVTGSQKGFMLPPGLAIIALSPKAQAAVESARLPRTFFDVRDMMKAYANNAYPYTPAVGLMNGLKQSCDMLLAEGLDNVFARHHRIAEGVRAAVRAWGLELCAQTPDVYSDSVSAIRTPEGFNATGIVTHAAAKYGVAFGVGLGEVAGKVFRIGHLGSLTDVMMLSGLATAEMVMADLGLDIQLGSGVAAAQEVYRSDSAIASKEAA

SEQ ID NO: 623 - protein, 397 aa, Roseovarius nubinhibens ISM
MSLQNPTFIPGPTNLPEVLRKACDMPTIDHRSPLFGDILRPARAGVQQVLKSRDAEILIFPSTGTGGWETALTNTLAPGDTVLAARNGMFSQRWVDMCQRHGLTVEIVETPWGEGIPADRFEEILSADKAHKIKAVLATHNETATGVRSDISAVRRAMDAAAHPALLFVDGVSSIGSMDFRFDDWGVDIAVSGSQKGFMLPAGLAILGLSPKAMAAAETATLPRAFFDIRDMKRAYDNAAYPYTPLVGLLNGLNLSTKMLLDEGLDNVFARHRRIADGVRAAVAAWGLPLCAATPDLYSDTVSAVRTPEGVDATEIVRRAAADYGVAFGVGLGQLSGKAFRIGHLGSLTDVMMLSGLATLEMCMADLGLDIRPGSGVAAAQDVYRKSQTPQAREAAE

SEQ ID NO: 624 - protein, 396 aa, Roseobacter sp. SK209-2-6
MSFQNPVFIPGPTNMPEALRKAVDMPTLDHRSPLFGQILHPALAGVKKVLKSESAEIFVFPSTGTGGWETSITNTLNAGDKILAARNGMFSHRWIDMCQRHGLDVQVVETPWGEGLPADRYEEILTADKNHEIKAVLATHNETATGVKSDIAAVRRALDAAGHPALLFVDGVSSIASMDFRMDEWDVDIAVTGSQKGFMLPPGLAIVGFSPKAMKASGTATLPRTFFDIKDMANGYAANAYPYTPSVGLLNGLNMACGMLLDEGLENVFARHHRIAEGVRAAVRAWGLELCAASPEVYSNSVSAIRTPEGFDANRFVSLAAEKYGVAFGTGLGEVAGKVFRIGHLGSLTDVMALSGIATAEMVMADLGLDIPLGSGVAAAQDYYRGHEVSASKVAA

SEQ ID NO: 625 - protein, 388 aa, Rhodobacterales bacterium HTCC2083
  MISC_FEATURE: scf_1106200183017 genomic scaffold
MSFQNPVFIPGPTNMPEEIRLACHMPTIDHRSPIFGGILHPCLDGVRRVLKSEKAHIYIFPSTGTGGWETTLTNTLSVGDKVLVARNGMFSHRWIDMCERHGLDVQIVEAAWGDGLPVAEYEAILKADTGHSIKAVLATHNETATGVKSDIAGVRKALDAAAHPALFFVDGVSSIGSMDFRMDDWGIDVAVTGSQKGFMLPAGLAIVGFSDKARAAVEIATLPRTFFDIRDMEKGYAANAFPYTPPVGLMNGLKHSLEMIEAEGLENVFARHTRIATGVRHAVDAWGLELCANAPELYSDSVSAIRTPEGFNATDIVTRADEQYGMAFGVGLGEVAGKVFRIGHLGMLTDAMMLSGLGVAEMVMKDLGFDIKLGSGVGAAQEFYRFGA

SEQ ID NO: 626 - protein, 396 aa, Agrobacterium sp. ATCC 31749 AGT22
MSTQNPIFIPGPTNIPEVLRKAVDMPTIDHRSPLFGNILHPALEGVKAILKTSKAEVFVFPSTGTGGWETAITNTLSAGDKVLATRNGMFSHRWIDMCQRHGLDVQVVMQEWGDGVPADTFEEILTADKGHEIKVVLATHNETATGVRSDIAAVRRALDNAKHPALLFVDGVSSIACYDFRMDEWGVDVAVTGSQKGFMLPPGLAILGFSQKALAATGSARLPRTFFDVRDMAKGYASNGYPYTPPVGLLNGLKVATDMLLDEGLENVFARHHRIAEGVRRAVSAWGLELCAARPELYSDSVSAIRTPEGFDANKIVAHALNTYGVAFGTGLGDVAGKVFRIGHLGSLTDVMALSGIATAEMVMADLGLPVTLGSGVAAAQQSYRQSAGNAQRKAT

SEQ ID NO: 627 - protein, 396 aa, Paracoccus sp. TRP; identical to SEQ ID NO: 374
  MISC_FEATURE (1)..(396): Paracoccus_TRP_Contig_10

SEQ ID NO: 628 - protein, 396 aa, Artificial Sequence
  synthetic peptide
  MISC_FEATURE (1)..(396): pAqui_F126
MSFQNPVFIPGPTNMPEVLRKAVDMPTLDHRSPLFGQILHPALAGVKKVLKSETAEIFVFPSTGTGGWETALTNTLSAGDKILAARNGMFSHRWIDMCQRHGLNVQVVETPWGEGLPADRYEEILTADTSHEIKAVLATHNETATGVKSDIAAVRRALDAAGHPALLFVDGVSSIASMDFRMDEWGVDIAVTGSQKGFMLPPGLAIVGFSPKAMKAAETATLPRTFFDIKDMAAGYANSAYPYTPSVGLLNGLNMACGMLLDEGLENVFARHHRIAEGVRAAVRAWGLELCAVSPDVYSDSVSAIRTPEGFDANKFVSLAAEKYGVAFGTGLGEVAGKVFRIGHLGSLTDVMALSGIATAEMVMADLGLNIQLGSGVAAAQDYYRGNTGASAKAAA

SEQ ID NO: 629 - protein, 396 aa, Oceanicola sp. HL-35
MSFQNPVFIPGPTNIPEFLRKACDMPTIDHRSPLFGQILHPARDGVRKVLKSETAEVFIFPSTGTGGWETALTNTLSPGDKVLAARNGMFSHRWIDMCQRHGLSVEIVETPWGHGLPSDRYEEILTADTGHRIKAVLATHNETATGVKSDIAAVRRALDAAGHPALLFVDGVSSIASMDFRFDEWGVDVAVAGSQKGFMLTAGLAILGFSAKAMAATKTAQLPRTFFDVHDMANGYAKNAYPYTPAVGLLNGLNESCRMLLDEGLENVFARHTRIAEGVRRAVDAWGLELCAASPEVWSDTVSAIRTPEGFNATEIVTHAANTYGVAFGVGLGEVAGKVFRIGHLGSLTDVMTLSGIATAEMCMADLGLDITLGSGVAAAQDYYRGHPAAALKSAA

SEQ ID NO: 630 - protein, 391 aa, Psychrobacter sp. G; identical to SEQ ID NO: 591

SEQ ID NO: 631 - protein, 396 aa, Ensifer meliloti Rm41
MYLQNPVFIPGPTNMPEVLRKASDMPTIDHRSPLFGEILRPALAGVKKVVKSQTASICLFPATGTGGWETAITNTLSPGDRVLVARYGMFSHRWIDMCQRHGLDVSVIETPWGSGAPVDRYEEMLTADKAHQIKAVLVTHNETATGVKSDIAAVRRALDAARHPAMLFVDGVSSIASMEFRMDDWGVDVAVTGSQKGFMLPAGLAITAFSPKALAALETAKLPRTFFDVRDMSKSYENNAYPYTPAVGLLNGLKVSTEMLLAEGLENVFARHNRIATGIRAAVRAWGLELCAMSEDLYSDTVSAIRTPDGFDATSIVTHAAKKYDVAFGVGLGEVAGKVFRIGHLGSLTDVMALSGIATAEMVMADLGLSIKLGSGVAAAQDYYRNNQVSAGRGAA

SEQ ID NO: 632 - protein, 397 aa, Roseovarius sp. MCTG156(2b)
MSDQNPVFIPGPTNIPDRLRRAMQVQTQDHRSPAFVNTLTPVLKGCKTVFGTTNGEIITFPASGTGGWEAAITNTLSPGDKVLVARYGMFSHRWIDMCQRHGLDVQIIECPWGGGAPADRFKEALTADKDHSIKAVLVTHNETATGVRSDIAAVRGAMKSAKHPALLMVDCVSSLGSMPFEMDKWGVDIAVSGSQKGFMLNTGMAILAVSPRALAMMDTAQLPRTFFDFRDMMGANAKGGFPYTPPLQLIYGMAESLNMLFEEGLDNVYARHTRIAEGVRRAVAAWGLKLVAQSPELYSDTVSAVFVPEGFDSNRLTERVFATYGMSFGVGLGEMNGRAFRIGHLGSLTESMMLSGLATLEMAMADLNYPVKLGSGVIAAQEYYRSTAKPILAEKAA

SEQ ID NO: 633 - protein, 396 aa, Rhizobium rhizogenes OK036
MYMQNPVFIPGPTNMPEVLRKATDMPTLDHRSPLFGEILRPALAGVKKILKTEAASVYVFPSTGTGGWETAITNTLSPGDRILAARHGMFSQRWIDMCQRHGLKVDIVEVAWGAGAPADRYEEILAADTAHEIKAVLVTHNETATGVKSDIAAVRQAIDAAKHPALLFVDGVSSIASMDFRMDEWSVDIAITGSQKGFMLPAGLAITAFSPKALAAVETAKLPRTFFDIRDMARSYANNAYPYTPAVGLLNGLKLSTELLLAEGLENVFARHRRIASGIRAAVRAWGLELCAKSEDLYSDTVSAIRTPEGFDATSIVAYAAKTYDVAFGVGLGEVAGKVFRIGHLGSLTDVMALSGIATAEMVMVDLGLNIKLGSGVAAAQDYYRAGRASKVQAAA

SEQ ID NO: 634 - protein, 396 aa, Rhizobium leguminosarum YR374
MYMQNPVFIPGPTNMPEILRKAADMPTLDHRSPLFGEILRPALAGVKKILKTEAASVYVFPSTGTGGWETAITNTLSPGDRVLAARYGMFSQRWIDMCQRHGLKVDIIEAAWGGGAPAARYEEILAADTAHEIKAVLVTHNETATGVKSDIAAVRRAIDAARHPALLFVDGVSSIASMDFRMDEWSVDIAVTGSQKGFMLPAGLAITAFSPKALAAVETAKLPRTFFNIGDMARSYANNAYPYTPAVGLLNGLKLSTELLLAEGLENVFARHRRIASGIRAAVRAWGLELCAMSEDLYSDTVSAIRTPEGFDATSIVAHAAKTYDVAFGVGLGEVAGKVFRIGHLGSLTDVMALSGIATAEMVMVDLGLDIKLGSGVAAAQDYYRDGRASKVRAAA

SEQ ID NO: 635 - protein, 396 aa, Methylobacterium sp. YR668; identical to SEQ ID NO: 419

SEQ ID NO: 636 - protein, 395 aa, Sinorhizobium americanum CCGM7
MSGYNHLFIPGPTNIPERVRQAMNLPMEDMRSPRYPELTLPLFADIKQVFKNKTGRVFIYPSSGTGAWEAAMTNVLSPGDRVLMSRFGQFSHLWVDMAERLGFEVDCLDREWGTGVPVELYAERLAADEAHEIKAVFVTHNETATGVTSDVAAVRAALDACGHPALLFVDGVSSIGSIDFRQDEWGVDCAVSGSQKGFMMPAGLGFLSVSQKALEAARTARHIRCYFSFEDMIKTNDTGYFPYTPPTQLLRGLRAALDLIFEEGLETIFARHHHLANGVRAAVSAWGLKLCATEPKWHSDTVSAIRLPEGIDGVEVIRHAYQAYNTSLGSGLSKVAGKVFRIGHLGSLNEVMVLGALSAAELTLLDCGVKIEPGAGVGAAISQFRSAAVSSAKAA

SEQ ID NO: 637 - protein, 396 aa, Sinorhizobium americanum CCGM7
MYLQNPVFIPGPTNMPEVLRKASDMPTIDHRSPLFGEILRPALAGVRKVVKSDAASIFVFPATGTGGWETAITNTLSPGDRVLVARYGMFSHRWIDMCQRHGLDVSVIETPWGSGAPVHRYEELLTADKAHQIKAVLVTHNETATGVKSDIAAVRHALDSARHPAMLFVDGVSSIASMEFRMDDWGVDVAVTGSQKGFMLPAGLAITAFSTKALAAVETAKLPRTFFDVRDMSKSYENNAYPYTPAVGLLNGLKLSTEMLLAEGLENVFARHNRIATGVRAAVRAWGLELCASSEDLYSDTVSAIRTPDGFDATSIVTHAAKKYDVAFGVGLGEVAGKVFRIGHLGSLTDVMALSGIATAEMVMADLGLGIKLGSGVAAAQEYYRKNQVPADRGAA

SEQ ID NO: 638 - protein, 396 aa, Palleronia marisminoris DSM 26347
MSFQNPVFIPGPTNIPERLRKACDMPTIDHRSPLFGQILHPAREGVRKVLKSNSAQVFIFPSTGTGGWEAALTNCLSAGDKVLAARNGMFSHRWIDMCQRHGLKVEIIETPWGHGVPADRYEEILAADENHEIKVVLATHNETATGVKSDIAAVRRALDAAGHPAMLFVDGVSSIASMDFRFDEWGVDVAVAGSQKGFMLAPGLAITAFSDKAMMATEAATLPRTFFDVKDMAKGYANNAYPYTPAVGLLNGLNEACGMLLDEGLENVFARHHRIAEGIRAAVGAWGLELCAVSPEVYSDTVSAIRTPEGFNATDIVSHAASAYGVAFGTGLGEVAGKVFRIGHLGSLTDVMALSGIATAEMVMADLGLDITLGSGVAAAQDCYRGNRLNADKAAA

SEQ ID NO: 639 - protein, 396 aa, Paracoccus aminovorans DSM 8537
MTSQNPIFIPGPTNIPEEMRKAVDMPTIDHRSPVFGRMLHPALEGVKKVLKTTQAQVFLFPSTGTGGWETAISNTLSPGDKVLAARNGMFSHRWIDMCQRHGLDVTYVETQWGEGIPADRFEEILTADKGHEIRAVLATHNETATGVKSDIAAVRRALDAAQHPALLLVDGVSSIGSMDFRMDEWGVDVAVTGSQKGFMLPPGLAIVGFSPKAMEAVESARLPRTFFDIRDMATGYARNGYPYTPPVGLINGLNLSCERLLSEGLENVFARHHRIASGVRAAVEAWGLKLCAVRPELYSDSVSAIRVPEGFDANLIVSHALETYDMAFGTGLGQVAGKVFRIGHLGSLTDAMALSGIATAEMVMADLGLPIKLGSGVAAAQDHYRRTTAAAQKKAA

SEQ ID NO: 640 - protein, 396 aa, Yangia pacifica CGMCC 1.3455; identical to SEQ ID NO: 577

SEQ ID NO: 641 - protein, 396 aa, Roseovarius indicus DSM 26383
MNLQNPVFIPGPTNIPEALRKACDMPTIDHRSAVFGEILHPLRAKLREVLKSESAEIFLFPATGTGGWETALTNTLSPGDKVLAARNGMFSHRWIDMCQRHGLDVHVVEVPWGEGIPAERLGGILAADAGHSFKAVLATHNETATGVQSDIGALRRAMDAAGHPAMLFVDGVSSIASMEFRFDDWGVDVAVTGSQKGFMLPAGLAITAFSPKAVAASVTAGLPRTFFDIRDMDKGYAQGGYPYTPPVGLINGLNAACDMLLAEGMEDVFARHARIANGVRAAVRAWGLELCAATPDVWSDTVSAIRTPPGVNATDIVTHAADAYGTAFGTGLGEVAGKVFRIGHLGSLTDVMALSGIATAEMCMADLGMKIELGSGVAAAQEVYRATHARKQKDAA

SEQ ID NO: 642 - protein, 395 aa, Jannaschia rubra DSM 16279; identical to SEQ ID NO: 431

SEQ ID NO: 643 - protein, 396 aa, Rhizobium etli bv. phaseoli IE4803
MYGQNPVFIPGPTNMPEILRKAADMPTMDHRSSMFGEILHPALTGVKQVLKTETASVFIFPATGSGGWETAITNTLSPGDRVVAGRHGMFSQKWIDMCRRHQLKVDAIECSWHDGVPLAQYEEFLNADKAHEIKAVLVTHNETATGVKSDVAAVRRLLNAANHPALLLVDGVSSIASMDFRMDEWGVDVAVTGSQKGFMLPVGLAITAFSPKAIAALDTAKLPRAFFDVRDMAKGYSTNGYPYTPSVGLLNGLKVSTELLLQEGLENVFARHRRIASGVRAAVRAWRLELYAAREELYSDTVTAVQTPAGFDASRFVTHAATKYDVAFGAGLGDVAGKVFRIGHVGSMTDVMALSGIATAEMVMVDLGLNIKLGSGVAAAQAIYRNSHTSAVEMVA

SEQ ID NO: 644 - protein, 397 aa, Roseivivax sediminis DSM 26472
MPGFSHLYIPGPTNLPEAVRRAMNVPMEDMRAPDFPDLTRPVFEKAQKVFRNSEGRVFIYPSSGTGAWEAAIQNTLSPGDKVLMSRFGQFSNLWVDMAQRMGLDVDVIDCEWGEGVPVDQYAERLKADKTHDYKAVFATHNETATGVTSDIKGVREALDAAGHPALLMVDGVSSVGSIEFDQDAWGVDCAVSGSQKGFMLPAGLGILSVSKWALEAHKTAEFPRCYFSFEDQIRMNDTGYFPYTPATQLLRGLDVSCDMLLDEGLENVWARHRRLASGVRAAVEAWGLTLCAARPELWSDTVSAIVVPDDRDARDVIAAAYAKYDTSLGSGLANVAGKVFRIGHLGWLNEGMVCTALSAAEMAMIECGFEIEAGSGVGAAIRLFATSDAPQMKIAAE

SEQ ID NO: 645 - protein, 396 aa, Roseivivax sediminis DSM 26472
MSFQNPVFIPGPTNIPERLRKACDMPTIDHRSPLFGQILHPAREGVQKVLKSDSAEVFIFPSTGTGGWETALSNTLSPGDKVLAARNGMFSHRWIDMCQRHDLDVTIVETPWGEGLPAARYEEVLAADTGHEIKAVLATHNETATGVKSDIAAVRRALDTAGHPAMLFVDGVSSIGSMDFRFDEWGVDVAVTGSQKGFMLSAGLAIVGFSDKAMQATKTARLPRTFFDVHDMAKGYANSAYPYTPAVGLLNGLNEACGMLLSEGLDNVFARHTRIAEGVRAAVGAWGLDLCATAPEFYSDTVSAIRTPEGFDATRVVTHAADVYGVAFGVGLGEVAGKVFRIGHLGSLTDVMTLSGIATAEMCMVDLGLDIELGSGVAAAQRIYRADAALARKDAA

SEQ ID NO: 646 - protein, 396 aa, Agrobacterium sp. KFB 330
MSTQNPIFIPGPTNIPEVLRKAVDMPTIDHRSPLFGNILHPALEGVKAILKTSKAEVFVFPSTGTGGWETAITNTLSAGDKVLATRNGMFSHRWIDMCQRHGLDVQVVMQEWGEGVPADTFEEILTADKGHEIKVVLATHNETATGVRSDIAAVRRALDNAKHPALLFVDGVSSIACYDFRMDEWGVDVAVTGSQKGFMLPPGLAIVGFSQKALAATGSARLPRTFFDVRDMAKGYAANGYPYTPPVGLLNGLKVATDMLLDEGLENVFARHHRIAEGVRCAVSAWGLKLCAARSDLYSNSVSAIRTPEGFDANKIVAHALNTYGVAFGTGLGDVAGKVFRIGHLGSLTDVMALSGIATAEMVMADLGLPVNLGSGVAAAQQSYRQSAGIAQRKAA

SEQ ID NO: 647 - protein, 396 aa, Leisingera sp. ANG-DT; identical to SEQ ID NO: 612

SEQ ID NO: 648 - protein, 396 aa, Methylobacterium sp. ME121; identical to SEQ ID NO: 401

SEQ ID NO: 649 - protein, 392 aa, Litoreibacter meonggei DSM 29466
MSFQNPVFIPGPTNMPEAVRQACYMPTIDHRSPTFGKILHPCLDGVRQVLKSKDAKIFIFPSTGTGGWETALSNTLNKGDKVLAARNGMFSHRWIDMCQRHGLDVHIVETPWGEGVPAGKYEEILKADKNHEIKVVLATHNETATGVKSDIAAVRKALDAAGHPAMLFVDGVSSIASMDFRFDEWGVDIAITGSQKGFMLPAGLAIIGFSSKAIAASANATLPRTFFDIKDMQKGYDANAFPYTPPVGLMNGLKLSLDMLLDEGLENVFARHHRIAEGVRKAVSAWGLELCAASPDLYSDTVSAIRTPEGFNATDIVTHAADKYDVAFGVGLGEVAGKVFRIGHLGSLTDVMTLSGLATAEMCMVDLGLDVKLGSGVAAAQEYYRTNPAAGK

SEQ ID NO: 650 - protein, 392 aa, Litoreibacter halocynthiae DSM 29467
MSFQNPVFIPGPTNMPEAVRQACYMPTIDHRSPTFGKILHPCLDGVRKVLKSKDAKIFIFPSTGTGGWETALSNTLSKGDKVLAARNGMFSHRWIDMCQRHGLDVHVVETPWGEGVPTDKYEEVLKADKNHEIKVVLATHNETATGVKSDIAAVRKALDAAGHPAMLFVDGVSSIASMDFRFDEWGVDIAITGSQKGFMLPAGLAIIGFSGKAIAAAENSDLPTTFFDIGDMQKGYNANAFPYTPPVGLMNGLKLSLDMLLDEGLENVFARHHRIAEGVRAAVSAWGLELCAASPDLYSDTVSAIRTPEGFNATDIVTLAAEKYGVAFGVGLGEVAGKVFRIGHLGSLTDVMMLSGLATAEMCMVDLGLDVKLGSGVAAAQEYYRTNPTAGK

SEQ ID NO: 651 - protein, 396 aa, Roseivivax lentus DSM 29430
MSTQNPVFIPGPTNIPERLLSAMHVQTRDHRAPDFVETFAPVLNDTKRVFGTKDGTVITFPASGTGGWEAAVTNTLSPGDKVLVARYGMFSHRWIDLCQRHGLDVQIIECPWGAGAPADKFESVLSEDKGHEIKAVLVTHNETATGVKSDIAAVRGAMDAASHPAMLFVDCVSSLASMPFEMDAWGVDIAVSGSQKGFMLATGMAILGVSPKALDAMEAAKLPRTFFDFRDMTKANASGGFPYTPPLQLIYGLRESLKMLFEEGLENVYDRHFRLAEGVRRATKAWGLDLVAQSPDLYSDTVSAIYVPKGFDSNALTQHAFDAYGVSFGIGLGEMNGKAFRIGHLGSLTDVMVLSGLGAIEMAMADLNYPITLGSGVAAAQEYYRSTHAPAVRSAA

SEQ ID NO: 652 - protein, 392 aa, Rhodovulum sulfidophilum DSM 2351
MHASNPIFLPGPTNLPEPLRRACDIPTMDHRSAAFGPILAAAKEGVARILGLSGGEVALFPATGTGGWEAAVTNALRPGDKVLAARHGMFSRKWIDLCQRHGLEVEIVERPWGEGVPVEEFAAALAADGGHQIRAVLVTHNETATGVTSDVAAVRAAMDAAGHPALLMVDGVSSIGSIEFRMDDWGVDLAVAGSQKGFMLPAGLAIIGISAKARQAMETAGLPRCFFDIRDMEDGNYPYTPPVGLINGLAVSTGLLLEEGMENVRARHHRIAEGVRRAVAAWDMTTCAAAPELCSDTVTAIVTPEGFDAGRIVRHAAEAYGVAFGGGLGEVAGKVFRIGHLGLMSDVMALSGIATAEMAMVDLGLPVRLGSGVAAAQEHYRNSRTAPVQAAA

SEQ ID NO: 653 - protein, 396 aa, Roseobacter denitrificans DSM 7001; identical to SEQ ID NO: 369

SEQ ID NO: 654 - protein, 396 aa, Leisingera sp. ANG-Vp
MSFQNPVFIPGPTNMPEALRKAVDMPTLDHRSPLFGQILHPALAGVKKVLKSENAEIFVFPSTGTGGWETAITNTLSADDKVLAARNGMFSHRWIDMCQRHGLDVQIVETPWGEGLPADRYEEILTADTAHEIKVVLATHNETATGVKSDIAAVRRALDAAGHPALLFVDGVSSIASMDFRMDEWGVDIAVTGSQKGFMLPPGLAIVGFSPKAMQAVEAATLPRTFFDIKDMALGYSNSAYPYTPSVGLLNGLNMACGMLLDEGLENVFARHYRIAEGVRAAVRAWGLELCAVSPDVYSDSVSAIRTPDGFDANKFVSLAAEKYGVAFGTGLGEVAGKVFRIGHLGSLTDVMALSGIATAEMVMADLGLNIQLGSGVAAAQDYYRGNQASSTKAAA

SEQ ID NO: 655 - protein, 397 aa, Marivita hallyeonensis DSM 29431
MSFQNPVFIPGPTNIPESLRKACDMPTIDHRSPLFGTILHPARKAVQAILKSTSAEVFIFPSTGTGGWETAITNTLSEGDTVLVARNGMFSHRWIDMCERHGLELIIVDVAWGQGIPADRFEEILTGDTAHRIKAVLATHNETATGVVSDIGAIRHAMDAAGHPAMLMVDGVSSIASMDFRFDAWGVDVAVTGSQKGFMLPPGLAIVGFSEKAMDATKTAGLHRTFFDVHDMMKGYANSAYPYTPAVGLMNGLNEACRMLMDEGLETVFARHHRIAEGVRRAVWAWGLELCAESPDVYSDTISAVRTPNGFNATDIVTHAASTYGVAFGVGLGDVAGKVFRIGHLGSLTEVMTLSGIATAEMCMVDLGLDIKLGSGVAAAQEYYRYGSEIEQKVAAQ

SEQ ID NO: 656 - protein, 396 aa, Labrenzia alba CECT 7551
MSFQNPVFIPGPTNMPEALRKACDMPTLDHRSPLFGEILRPVLAGVKKILKTETAEVFIFPSTGTGGWETVLTNTLSADDKILAARNGMFSHRWIDMCQRHGLKVEVVETPWGAGLPADRYEEILTADTNHEIKAVLATHNETATGVKSNIAAVRRALSAAKHPALLLVDGVSSIASMDFRMDEWGVDAAVTGSQKGFMLPAGLAIVALSPKAQAAIETAKLPRTFFDVRDMMKAYATNAYPYTPAVGLLNGLKTSCDMLLGEGLENVFTRHHRIAEGVRSAVRAWGLELCAKTPDVYSDTVSAIYTPEGFNATDIVTHAAGKYGVAFGVGLGEVAGKAFRIGHLGSLTDVMTLSGLATAEMVMVDLGLDIKLGSGVAAAQEYYRNEEALASKEAA

SEQ ID NO: 657 - protein, 396 aa, Thalassobius abyssi DSM 100673
MSFQNPVFIPGPTNMPEALRRAVDMPTLDHRSSLFAEMLHPARAGVKKVLKSETAEVFFFPSTGTGGWETALTNTLSPGDTILAARNGMFSHRWIDMCQRHGLNVQVVETEWGLGLPADRFEEILSSDTSHQIKVVLATHNETATGVKSDIAAVRKALDAAGHPAMLYVDGVSSIASMDFRMDEWGVDIAVTGSQKGFMLPAGLAIVGFSPKAMQMVEAATLPRTFFDIRDMGRSYAANGYPYTPAVGLLNGLNKSCDMLLAEGLENVFARHHRIASGVRAAVHAWGMELCAASPDLYSDSVSAIRTPDGFDATQFVTHAADTYGVAFGVGLGDVAGKVFRIGHLGMLTDVMALSGIATAEMCMADLGLDIRLGSGVAAAQEVYRGSTAKPLKEAA

SEQ ID NO: 658 - protein, 396 aa, Roseovarius indicus B108; identical to SEQ ID NO: 641
  MISC_FEATURE (1)..(396): cultivar:MA

SEQ ID NO: 659 - protein, 397 aa, Litoreibacter ponti DSM 100977
MRTSQNPVFIPGPTNMPEHLRKAADMATLDHRGPAFAGMLKPALEGVKTILGTTDGEVILFPATGTGGWEAAVSNTLSPGDTVLAARFGMFSHRWIDLCQRHGLNVQIIETPWGEGAPIAAIEEALTNDKEHRIKAVLATHNETATGVKSDIAAVRGAMDAAGHPAMFFVDGVSSIASMPFHMDDWGVDVAITGSQKGFMLPAGLAICGISPKAVAAMETAKLPRTFFDFRDMRDSMAGGGFPYTPPVGLIHGLSVAVEDLLTEGLDNVYARHTRIATGVRAAIEAWGMTPYAKTPDLFSDTVTAVKVPDGFNGTDVVTRAASEYDMAFGVGLGEVAGKVFRIGHLGQLTDAMMLSGLSVAEMCMADLGYPIELGSGVAAAQSVYRHGDNVLALAAE

SEQ ID NO: 660 - protein, 399 aa, Yangia sp. CCB-MM3
MSFQNPVFIPGPTNIPESLRKACDMPTIDHRSPLFGQILHPARERVRRVLKSASAEVFIFPSTGTGGWETALTNTLSPGDTVLAARNGMFSHRWIDMCQRHGLTVEVVETAWGEGLPADRYAEILAADKSRRIKAVLATHNETATGVRSDIAAVRRALDDVDHPALLFVDGVSSIASMDFRFDDWGVDVAVTGSQKGFMLPPGLAITGFSEKAMAATQTAKLPRTFFDVHDMAKGYANDAYPYTPAVGLLNGLNEACRMLLDEGLENVFARHHRIAEGVRAAVGAWGLELCAASPDLYSDTVSAIRTPEGFNATDIVSHAAQTYGVAFGTGLGEVAGKVFRIGHLGSLTDVMALSGLATAEMCMKDLGLKITLGSGVAAAQEVYRTSTATARTASQEAA

SEQ ID NO: 661 - protein, 393 aa, Granulosicoccus antarcticus IMCC3135
MNGQNPIFIPGPTNIPDRLRAAMNVQSSDHRAPDFKEIFLPVLADVKKIFKMSGGEVIIFPASGTGGWEASVTNTLSPGDKVLVARYGMFSHRWIDLCQRQGLDVEIIECAWGSAAPADLFAQRLAADPEGRIKAVLVTHNETATGVRSDIAGVRKAMNASDHAALLFVDCVSSLGCMDFRMDEWGVDLAVAGSQKGFMLNTGMAIVGVSDKALAAMDSARCPRCFFDFRDMLAANQKGGYPYTPPLQLIHGLRASVDMLLEEGLDAVFARHFRLAEGVRQAVAAWGLTLCAQSADLYSDTVSAIYVPEGLNSDALTDHAYHTYDVSFGVGLGEMAGKAFRIGHLGSLSDLMVLSGLAGIEMAMKDLDYPIELGSGVAAAQAYYRKTAAGNTQ

SEQ ID NO: 662 - protein, 397 aa, Tateyamaria omphalii DOK1-4
MSFQNPVFIPGPTNIPESLRKSCDMPTIDHRSPLFGGILNAARDGVRQVLKSATAEVFIFPATGTGGWETALTNTLSPGDTVLAARNGMFSHRWIDMCQRLGLTVRVVETPWGQGIPHDQFAEILAADTSHEIKAVLATHNETATGVTSDIAAVRAAMDGSDHPAMLFVDGVSSIGSIDFQFDDWGVDVAVTGSQKGFMLPAGLAIVGFSAKAMAAQPSAQLPRTFFDIRDMADGYAAGAYPYTPAVGLMNGLSHACTMLLSEGLDTVFARHHRIASGVRAAVSAWGLELCAASPDLYSDTVSAIRTPAGFDASRIVSHAATTYGVAFGGGLGEVAGKVFRIGHLGSLTDVMALSGIATAEMCMADHGLDITLGSGVAAAQDVYRAHGAANVQKDAA

SEQ ID NO: 663 - protein, 252 aa, Artificial Sequence
  synthetic peptide (Conserved amino acid sequence of the iminosuccinate reductase)
  misc_feature (2)..(2): Xaa can be any naturally occurring amino acid
  misc_feature (4)..(4): Xaa can be any naturally occurring amino acid
  misc_feature (6)..(14): Xaa can be any naturally occurring amino acid
  misc_feature (16)..(16): Xaa can be any naturally occurring amino acid
  misc_feature (18)..(18): Xaa can be any naturally occurring amino acid
  misc_feature (21)..(22): Xaa can be any naturally occurring amino acid
  misc_feature (24)..(24): Xaa can be any naturally occurring amino acid
  misc_feature (26)..(32): Xaa can be any naturally occurring amino acid
  misc_feature (37)..(39): Xaa can be any naturally occurring amino acid
  misc_feature (42)..(45): Xaa can be any naturally occurring amino acid
  misc_feature (47)..(54): Xaa can be any naturally occurring amino acid
  misc_feature (56)..(57): Xaa can be any naturally occurring amino acid
  misc_feature (60)..(60): Xaa can be any naturally occurring amino acid
  misc_feature (65)..(68): Xaa can be any naturally occurring amino acid
  misc_feature (70)..(72): Xaa can be any naturally occurring amino acid
  misc_feature (74)..(81): Xaa can be any naturally occurring amino acid
  misc_feature (83)..(84): Xaa can be any naturally occurring amino acid
  misc_feature (88)..(88): Xaa can be any naturally occurring amino acid
  misc_feature (90)..(92): Xaa can be any naturally occurring amino acid
  misc_feature (94)..(108): Xaa can be any naturally occurring amino acid
  misc_feature (111)..(149): Xaa can be any naturally occurring amino acid
  misc_feature (151)..(165): Xaa can be any naturally occurring amino acid
  misc_feature (167)..(169): Xaa can be any naturally occurring amino acid
  misc_feature (175)..(176): Xaa can be any naturally occurring amino acid
  misc_feature (178)..(178): Xaa can be any naturally occurring amino acid
  misc_feature (180)..(192): Xaa can be any naturally occurring amino acid
  misc_feature (194)..(196): Xaa can be any naturally occurring amino acid
  misc_feature (198)..(201): Xaa can be any naturally occurring amino acid
  misc_feature (204)..(204): Xaa can be any naturally occurring amino acid
  misc_feature (206)..(221): Xaa can be any naturally occurring amino acid
  misc_feature (223)..(231): Xaa can be any naturally occurring amino acid
  misc_feature (233)..(238): Xaa can be any naturally occurring amino acid
  misc_feature (240)..(241): Xaa can be any naturally occurring amino acid
  misc_feature (244)..(244): Xaa can be any naturally occurring amino acid
  misc_feature (246)..(248): Xaa can be any naturally occurring amino acid
  misc_feature (251)..(251): Xaa can be any naturally occurring amino acid
GXKXGXXXXXXXXXGXKXGGXXPXNXXXXXXXNHQSXXXLFXXXXGXXXXXXXXNXXTAXRTAAXXXXSXXXLXXXXXXXXGXXGAGXQXXXQXXXXXXXXXXXXXXXWNXXXXXXXXXXXXXXXXXXXXXXXXXXXXXXXXXXXXXXXSXXXXXXXXXXXXXXXHXXXMGTDTXXKXEXXXXXXXXXXXXXDXXXQXXXXGEXQXXXXXXXXXXXXXXXXGXXXXXXXXXRXXXXXXTXXDGXGXXXQDXA

SEQ ID NO: 664 - protein, 270 aa, Artificial Sequence
  synthetic peptide (Conserved amino acid sequence of the aspartate-glyoxylate transaminase)
  misc_feature (2)..(13): Xaa can be any naturally occurring amino acid
  misc_feature (15)..(16): Xaa can be any naturally occurring amino acid
  misc_feature (18)..(29): Xaa can be any naturally occurring amino acid
  misc_feature (33)..(33): Xaa can be any naturally occurring amino acid
  misc_feature (37)..(37): Xaa can be any naturally occurring amino acid
  misc_feature (39)..(58): Xaa can be any naturally occurring amino acid
  misc_feature (60)..(60): Xaa can be any naturally occurring amino acid
  misc_feature (64)..(68): Xaa can be any naturally occurring amino acid
  misc_feature (70)..(73): Xaa can be any naturally occurring amino acid
  misc_feature (75)..(76): Xaa can be any naturally occurring amino acid
  misc_feature (78)..(81): Xaa can be any naturally occurring amino acid
  misc_feature (87)..(87): Xaa can be any naturally occurring amino acid
  misc_feature (89)..(91): Xaa can be any naturally occurring amino acid
  misc_feature (93)..(130): Xaa can be any naturally occurring amino acid
  misc_feature (132)..(132): Xaa can be any naturally occurring amino acid
  misc_feature (135)..(140): Xaa can be any naturally occurring amino acid
  misc_feature (142)..(152): Xaa can be any naturally occurring amino acid
  misc_feature (154)..(160): Xaa can be any naturally occurring amino acid
  misc_feature (163)..(165): Xaa can be any naturally occurring amino acid
  misc_feature (167)..(169): Xaa can be any naturally occurring amino acid
  misc_feature (171)..(175): Xaa can be any naturally occurring amino acid
  misc_feature (177)..(181): Xaa can be any naturally occurring amino acid
  misc_feature (183)..(188): Xaa can be any naturally occurring amino acid
  misc_feature (190)..(197): Xaa can be any naturally occurring amino acid
  misc_feature (199)..(218): Xaa can be any naturally occurring amino acid
  misc_feature (220)..(220): Xaa can be any naturally occurring amino acid
  misc_feature (222)..(229): Xaa can be any naturally occurring amino acid
  misc_feature (232)..(232): Xaa can be any naturally occurring amino acid
  misc_feature (235)..(235): Xaa can be any naturally occurring amino acid
  misc_feature (237)..(250): Xaa can be any naturally occurring amino acid
  misc_feature (252)..(263): Xaa can be any naturally occurring amino acid
  misc_feature (265)..(265): Xaa can be any naturally occurring amino acid
  misc_feature (267)..(268): Xaa can be any naturally occurring amino acid
WXXXXXXXXXXXXLXXDXXXXXXXXXXXXNETXTGVXSXXXXXXXXXXXXXXXXXXXXDXVSSXXXXXFXXXXWXXDXXXXGSQKGXMXXXGXXXXXXXXXXXXXXXXXXXXXXXXXXXXXXXXXXXXXXPXTPXXXXXXGXXXXXXXXXXXEXXXXXXXRHXXXAXXXRXXXXXWXXXXXAXXXXXXSXXXXXXXXPXXXXXXXXXXXXXXXXXXXXGXGXXXXXXXXFRXGHXGXXXXXXXXXXXXXXEXXXXXXXXXXXXGXGXXAA

SEQ ID NO: 665 - protein, 289 aa, Artificial Sequence
  synthetic peptide (Conserved amino acid sequence of the aspartate-glyoxylate transaminase)
  MISC_FEATURE (1)..(1): Xaa can be any naturally occurring amino acid selected from A, C, F, G, H, I, K, L, M, R, T, V, W, Y
  MISC_FEATURE (2)..(2): Xaa can be any naturally occurring amino acid selected from A, C, D, G, N, P, S, T and V
  misc_feature (3)..(3): Xaa can be any naturally occurring amino acid
  MISC_FEATURE (4)..(4): Xaa can be any naturally occurring amino acid selected from H, K and R
  misc_feature (5)..(5): Xaa can be any naturally occurring amino acid
  MISC_FEATURE (6)..(6): Xaa can be any naturally occurring amino acid selected from A, C, D, E, G, H, K, N, Q, R, S and T
  MISC_FEATURE (7)..(7): Xaa can be any naturally occurring amino acid selected from A, C, F, G, H, I, K, L, M, R, T, V, W, Y
  misc_feature (8)..(8): Xaa can be any naturally occurring amino acid
  MISC_FEATURE (9)..(9): Xaa can be any naturally occurring amino acid selected from A, C, F, G, H, I, K, L, M, R, T, V, W, Y
  misc_feature (10)..(11): Xaa can be any naturally occurring amino acid
  MISC_FEATURE (12)..(12): Xaa can be any naturally occurring amino acid selected from A, C, F, G, H, I, K, L, M, R, T, V, W, Y
  misc_feature (13)..(15): Xaa can be any naturally occurring amino acid
  MISC_FEATURE (17)..(17): Xaa can be any naturally occurring amino acid selected from A, C, D, E, G, H, K, N, Q, R, S and T
  misc_feature (18)..(18): Xaa can be any naturally occurring amino acid
  MISC_FEATURE (19)..(19): Xaa can be any naturally occurring amino acid selected from A, C, D, G, N, P, S, T and V
  MISC_FEATURE (20)..(20): Xaa can be any naturally occurring amino acid selected from A, C, F, G, H, I, K, L, M, R, T, V, W, Y
  MISC_FEATURE (21)..(21): Xaa can be any naturally occurring amino acid selected from A, C, D, G, N, P, S, T and V
  misc_feature (22)..(24): Xaa can be any naturally occurring amino acid
  MISC_FEATURE (25)..(25): Xaa can be any naturally occurring amino acid selected from A, C, F, G, H, I, K, L, M, R, T, V, W, Y
  MISC_FEATURE (26)..(27): Xaa can be any naturally occurring amino acid selected from A, C, D, E, G, H, K, N, Q, R, S and T
  misc_feature (28)..(28): Xaa can be any naturally occurring amino acid
  misc_feature (30)..(31): Xaa can be any naturally occurring amino acid
  misc_feature (33)..(36): Xaa can be any naturally occurring amino acid
  MISC_FEATURE (37)..(37): Xaa can be any naturally occurring amino acid selected from A, C, F, G, H, I, K, L, M, R, T, V, W, Y
  MISC_FEATURE (38)..(38): Xaa can be any naturally occurring amino acid selected from C, D, E, H, K, N, Q, R, S and T
  MISC_FEATURE (39)..(39): Xaa can be any naturally occurring amino acid selected from A, C, D, G, N, P, S, T and V
  MISC_FEATURE (40)..(40): Xaa can be any naturally occurring amino acid selected from I, L, V
  MISC_FEATURE (40)..(40): Xaa can be any naturally occurring amino acid selected from I,L and V
  MISC_FEATURE (41)..(41): Xaa can be any naturally occurring amino acid selected from A, C, F, G, H, I, K, L, M, R, T, V, W, Y
  MISC_FEATURE (42)..(43): Xaa can be any naturally occurring amino acid selected from A, C, D, G, N, P, S, T and V
  MISC_FEATURE (44)..(44): Xaa can be any naturally occurring amino acid selected from C, D, E, H, K, N, Q, R, S and T
  MISC_FEATURE (48)..(48): Xaa can be any naturally occurring amino acid selected from A, G and S
  misc_feature (52)..(52): Xaa can be any naturally occurring amino acid
  MISC_FEATURE (54)..(54): Xaa can be any naturally occurring amino acid selected from C, D, E, H, K, N, Q, R, S and T
  MISC_FEATURE (55)..(55): Xaa can be any naturally occurring amino acid selected from I, L, V
  MISC_FEATURE (55)..(55): Xaa can be any naturally occurring amino acid selected from I,L and V
  MISC_FEATURE (56)..(56): Xaa can be any naturally occurring amino acid selected from A, C, D, E, G, H, K, N, Q, R, S and T
  misc_feature (57)..(57): Xaa can be any naturally occurring amino acid
  MISC_FEATURE (58)..(58): Xaa can be any naturally occurring amino acid selected from A, C, F, G, H, I, K, L, M, R, T, V, W, Y
  MISC_FEATURE (59)..(60): Xaa can be any naturally occurring amino acid selected from A, C, D, E, G, H, K, N, Q, R, S and T
  misc_feature (61)..(61): Xaa can be any naturally occurring amino acid
  MISC_FEATURE (62)..(62): Xaa can be any naturally occurring amino acid selected from A, C, F, G, H, I, K, L, M, R, T, V, W, Y
  misc_feature (63)..(66): Xaa can be any naturally occurring amino acid
  MISC_FEATURE (67)..(67): Xaa can be any naturally occurring amino acid selected from C, D, E, H, K, N, Q, R, S and T
  misc_feature (68)..(68): Xaa can be any naturally occurring amino acid
  MISC_FEATURE (69)..(69): Xaa can be any naturally occurring amino acid selected from A, G and S
  MISC_FEATURE (70)..(72): Xaa can be any naturally occurring amino acid selected from A, C, F, G, H, I, K, L, M, R, T, V, W, Y
  MISC_FEATURE (73)..(73): Xaa can be any naturally occurring amino acid selected from I,L and V
  MISC_FEATURE (75)..(75): Xaa can be any naturally occurring amino acid selected from A, C, D, G, N, P, S, T and V
  MISC_FEATURE (79)..(79): Xaa can be any naturally occurring amino acid selected from I,L and V
  MISC_FEATURE (80)..(80): Xaa can be any naturally occurring amino acid selected from A, G and S
  MISC_FEATURE (81)..(81): Xaa can be any naturally occurring amino acid selected from A, C, D, G, N, P, S, T and V
  MISC_FEATURE (82)..(82): Xaa can be any naturally occurring amino acid selected from A, C, F, G, H, I, K, L, M, R, T, V, W, Y
  misc_feature (83)..(83): Xaa can be any naturally occurring amino acid
  MISC_FEATURE (85)..(85): Xaa can be any naturally occurring amino acid selected from A, C, D, E, G, H, K, N, Q, R, S and T
  misc_feature (86)..(86): Xaa can be any naturally occurring amino acid
  MISC_FEATURE (87)..(88): Xaa can be any naturally occurring amino acid selected from A, C, D, E, G, H, K, N, Q, R, S and T
  misc_feature (90)..(90): Xaa can be any naturally occurring amino acid
  MISC_FEATURE (91)..(91): Xaa can be any naturally occurring amino acid selected from I,L and V
  MISC_FEATURE (93)..(93): Xaa can be any naturally occurring amino acid selected from A, C, F, G, H, I, K, L, M, R, T, V, W, Y
  MISC_FEATURE (94)..(94): Xaa can be any naturally occurring amino acid selected from A, C, D, G, N, P, S, T and V
  MISC_FEATURE (95)..(95): Xaa can be any naturally occurring amino acid selected from I,L and V
  MISC_FEATURE (96)..(96): Xaa can be any naturally occurring amino acid selected from A, C, D, G, N, P, S, T and V
  MISC_FEATURE (102)..(102): Xaa can be any naturally occurring amino acid selected from A, C, F, G, H, I, K, L, M, R, T, V, W, Y
  MISC_FEATURE (104)..(104): Xaa can be any naturally occurring amino acid selected from A, C, F, G, H, I, K, L, M, R, T, V, W, Y
  misc_feature (105)..(105): Xaa can be any naturally occurring amino acid
  MISC_FEATURE (106)..(106): Xaa can be any naturally occurring amino acid selected from A, C, D, G, N, P, S, T and V
  MISC_FEATURE (108)..(108): Xaa can be any naturally occurring amino acid selected from A, C, F, G, H, I, K, L, M, R, T, V, W, Y
  MISC_FEATURE (109)..(109): Xaa can be any naturally occurring amino acid selected from A, C, D, G, N, P, S, T and V
  MISC_FEATURE (110)..(111): Xaa can be any naturally occurring amino acid selected from A, C, F, G, H, I, K, L, M, R, T, V, W, Y
  MISC_FEATURE (112)..(112): Xaa can be any naturally occurring amino acid selected from A, C, D, G, N, P, S, T and V
  MISC_FEATURE (113)..(113): Xaa can be any naturally occurring amino acid selected from A, C, F, G, H, I, K, L, M, R, T, V, W, Y
  MISC_FEATURE (114)..(114): Xaa can be any naturally occurring amino acid selected from A, G and S
  misc_feature (115)..(115): Xaa can be any naturally occurring amino acid
  MISC_FEATURE (116)..(116): Xaa can be any naturally occurring amino acid selected from A, C, F, G, H, I, K, L, M, R, T, V, W, Y
  MISC_FEATURE (117)..(117): Xaa can be any naturally occurring amino acid selected from A, G and S
  misc_feature (118)..(123): Xaa can be any naturally occurring amino acid
  MISC_FEATURE (124)..(124): Xaa can be any naturally occurring amino acid selected from A, C, D, G, N, P, S, T and V
  misc_feature (125)..(125): Xaa can be any naturally occurring amino acid
  MISC_FEATURE (126)..(126): Xaa can be any naturally occurring amino acid selected from A, C, F, G, H, I, K, L, M, R, T, V, W, Y
  misc_feature (127)..(127): Xaa can be any naturally occurring amino acid
  MISC_FEATURE (128)..(128): Xaa can be any naturally occurring amino acid selected from C, D, E, H, K, N, Q, R, S and T
  MISC_FEATURE (129)..(129): Xaa can be any naturally occurring amino acid selected from A, C, F, G, H, I, K, L, M, R, T, V, W, Y
  MISC_FEATURE (130)..(130): Xaa can be any naturally occurring amino acid selected from F, H, W and Y
  MISC_FEATURE (131)..(131): Xaa can be any naturally occurring amino acid selected from A, C, F, G, H, I, K, L, M, R, T, V, W, Y
  MISC_FEATURE (132)..(132): Xaa can be any naturally occurring amino acid selected from A, C, D, E, G, H, K, N, Q, R, S and T
  MISC_FEATURE (133)..(133): Xaa can be any naturally occurring amino acid selected from A, C, F, G, H, I, K, L, M, R, T, V, W, Y
  MISC_FEATURE (134)..(135): Xaa can be any naturally occurring amino acid selected from A, C, D, E, G, H, K, N, Q, R, S and T
  misc_feature (136)..(144): Xaa can be any naturally occurring amino acid
  MISC_FEATURE (145)..(145): Xaa can be any naturally occurring amino acid selected from A, C, F, G, H, I, K, L, M, R, T, V, W, Y
  misc_feature (147)..(147): Xaa can be any naturally occurring amino acid
  misc_feature (150)..(151): Xaa can be any naturally occurring amino acid
  MISC_FEATURE (152)..(152): Xaa can be any naturally occurring amino acid selected from A, C, D, E, G, H, K, N, Q, R, S and T
  MISC_FEATURE (153)..(154): Xaa can be any naturally occurring amino acid selected from A, C, F, G, H, I, K, L, M, R, T, V, W, Y
  misc_feature (155)..(155): Xaa can be any naturally occurring amino acid
  MISC_FEATURE (157)..(157): Xaa can be any naturally occurring amino acid selected from A, C, F, G, H, I, K, L, M, R, T, V, W, Y
  misc_feature (158)..(159): Xaa can be any naturally occurring amino acid
  MISC_FEATURE (160)..(160): Xaa can be any naturally occurring amino acid selected from A, C, D, G, N, P, S, T and V
  misc_feature (161)..(161): Xaa can be any naturally occurring amino acid
  MISC_FEATURE (162)..(162): Xaa can be any naturally occurring amino acid selected from A, C, D, E, G, H, K, N, Q, R, S and T
  misc_feature (163)..(163): Xaa can be any naturally occurring amino acid
  MISC_FEATURE (164)..(164): Xaa can be any naturally occurring amino acid selected from A, C, F, G, H, I, K, L, M, R, T, V, W, Y
  misc_feature (165)..(166): Xaa can be any naturally occurring amino acid
  MISC_FEATURE (167)..(167): Xaa can be any naturally occurring amino acid selected from A, C, D, E, G, H, K, N, Q, R, S and T
  MISC_FEATURE (169)..(169): Xaa can be any naturally occurring amino acid selected from A, C, D, E, G, H, K, N, Q, R, S and T
  MISC_FEATURE (170)..(170): Xaa can be any naturally occurring amino acid selected from A, C, F, G, H, I, K, L, M, R, T, V, W, Y
  misc_feature (171)..(171): Xaa can be any naturally occurring amino acid
  MISC_FEATURE (172)..(172): Xaa can be any naturally occurring amino acid selected from A, C, D, E, G, H, K, N, Q, R, S and T
  MISC_FEATURE (173)..(173): Xaa can be any naturally occurring amino acid selected from I,L and V
  MISC_FEATURE (174)..(174): Xaa can be any naturally occurring amino acid selected from A, C, F, G, H, I, K, L, M, R, T, V, W, Y
  MISC_FEATURE (175)..(175): Xaa can be any naturally occurring amino acid selected from A, C, D, E, G, H, K, N, Q, R, S and T
  misc_feature (178)..(178): Xaa can be any naturally occurring amino acid
  MISC_FEATURE (179)..(180): Xaa can be any naturally occurring amino acid selected from A, C, F, G, H, I, K, L, M, R, T, V, W, Y
  MISC_FEATURE (182)..(182): Xaa can be any naturally occurring amino acid selected from A, C, D, E, G, H, K, N, Q, R, S and T
  MISC_FEATURE (183)..(183): Xaa can be any naturally occurring amino acid selected from A, G and S
  MISC_FEATURE (184)..(184): Xaa can be any naturally occurring amino acid selected from A, C, F, G, H, I, K, L, M, R, T, V, W, Y
  misc_feature (186)..(186): Xaa can be any naturally occurring amino acid
  MISC_FEATURE (187)..(187): Xaa can be any naturally occurring amino acid selected from A, G and S
  MISC_FEATURE (188)..(188): Xaa can be any naturally occurring amino acid selected from A, C, F, G, H, I, K, L, M, R, T, V, W, Y
  misc_feature (189)..(189): Xaa can be any naturally occurring amino acid
  MISC_FEATURE (190)..(190): Xaa can be any naturally occurring amino acid selected from A, G and S
  MISC_FEATURE (192)..(192): Xaa can be any naturally occurring amino acid selected from A, C, D, E, G, H, K, N, Q, R, S and T
  MISC_FEATURE (193)..(193): Xaa can be any naturally occurring amino acid selected from A, C, F, G, H, I, K, L, M, R, T, V, W, Y
  misc_feature (194)..(195): Xaa can be any naturally occurring amino acid
  MISC_FEATURE (196)..(196): Xaa can be any naturally occurring amino acid selected from A, C, F, G, H, I, K, L, M, R, T, V, W, Y
  misc_feature (198)..(198): Xaa can be any naturally occurring amino acid
  MISC_FEATURE (199)..(199): Xaa can be any naturally occurring amino acid selected from A, C, D, E, G, H, K, N, Q, R, S and T
  misc_feature (200)..(200): Xaa can be any naturally occurring amino acid
  MISC_FEATURE (201)..(201): Xaa can be any naturally occurring amino acid selected from A, C, D, E, G, H, K, N, Q, R, S and T
  misc_feature (202)..(203): Xaa can be any naturally occurring amino acid
  misc_feature (205)..(205): Xaa can be any naturally occurring amino acid
  MISC_FEATURE (206)..(206): Xaa can be any naturally occurring amino acid selected from S and T
  MISC_FEATURE (207)..(207): Xaa can be any naturally occurring amino acid selected from I,L and V
  MISC_FEATURE (208)..(208): Xaa can be any naturally occurring amino acid selected from S and T
  MISC_FEATURE (209)..(209): Xaa can be any naturally occurring amino acid selected from A, C, D, G, N, P, S, T and V
  MISC_FEATURE (210)..(210): Xaa can be any naturally occurring amino acid selected from I,L and V
  misc_feature (211)..(211): Xaa can be any naturally occurring amino acid
  MISC_FEATURE (212)..(212): Xaa can be any naturally occurring amino acid selected from A, C, F, G, H, I, K, L, M, R, T, V, W, Y
  misc_feature (214)..(214): Xaa can be any naturally occurring amino acid
  MISC_FEATURE (215)..(215): Xaa can be any naturally occurring amino acid selected from A, C, D, E, G, H, K, N, Q, R, S and T
  MISC_FEATURE (216)..(216): Xaa can be any naturally occurring amino acid selected from A, C, F, G, H, I, K, L, M, R, T, V, W, Y
  MISC_FEATURE (217)..(217): Xaa can be any naturally occurring amino acid selected from C, D, E, H, K, N, Q, R, S and T
  MISC_FEATURE (218)..(218): Xaa can be any naturally occurring amino acid selected from A, G and S
  misc_feature (219)..(220): Xaa can be any naturally occurring amino acid
  MISC_FEATURE (221)..(222): Xaa can be any naturally occurring amino acid selected from A, C, F, G, H, I, K, L, M, R, T, V, W, Y
  MISC_FEATURE (223)..(223): Xaa can be any naturally occurring amino acid selected from A, C, D, E, G, H, K, N, Q, R, S and T
  misc_feature (224)..(224): Xaa can be any naturally occurring amino acid
  MISC_FEATURE (225)..(225): Xaa can be any naturally occurring amino acid selected from A, C, D, G, N, P, S, T and V
  misc_feature (226)..(228): Xaa can be any naturally occurring amino acid
  MISC_FEATURE (229)..(229): Xaa can be any naturally occurring amino acid selected from F, H, W and Y
  MISC_FEATURE (230)..(230): Xaa can be any naturally occurring amino acid selected from A, C, D, E, G, H, K, N, Q, R, S and T
  MISC_FEATURE (231)..(231): Xaa can be any naturally occurring amino acid selected from A, C, F, G, H, I, K, L, M, R, T, V, W, Y
  MISC_FEATURE (232)..(232): Xaa can be any naturally occurring amino acid selected from A, G and S
  MISC_FEATURE (233)..(233): Xaa can be any naturally occurring amino acid selected from A, C, F, G, H, I, K, L, M, R, T, V, W, Y
  misc_feature (235)..(235): Xaa can be any naturally occurring amino acid
  MISC_FEATURE (237)..(237): Xaa can be any naturally occurring amino acid selected from A, C, F, G, H, I, K, L, M, R, T, V, W, Y
  misc_feature (238)..(239): Xaa can be any naturally occurring amino acid
  MISC_FEATURE (240)..(240): Xaa can be any naturally occurring amino acid selected from A, C, F, G, H, I, K, L, M, R, T, V, W, Y
  misc_feature (241)..(241): Xaa can be any naturally occurring amino acid
  MISC_FEATURE (242)..(242): Xaa can be any naturally occurring amino acid selected from A, C, D, G, N, P, S, T and V
  MISC_FEATURE (243)..(243): Xaa can be any naturally occurring amino acid selected from C, D, E, H, K, N, Q, R, S and T
  MISC_FEATURE (244)..(244): Xaa can be any naturally occurring amino acid selected from A, C, F, G, H, I, K, L, M, R, T, V, W, Y
  MISC_FEATURE (247)..(247): Xaa can be any naturally occurring amino acid selected from I,L and V
  MISC_FEATURE (250)..(250): Xaa can be any naturally occurring amino acid selected from I,L and V
  misc_feature (252)..(252): Xaa can be any naturally occurring amino acid
  MISC_FEATURE (253)..(253): Xaa can be any naturally occurring amino acid selected from A, C, F, G, H, I, K, L, M, R, T, V, W, Y
  MISC_FEATURE (254)..(254): Xaa can be any naturally occurring amino acid selected from A, C, D, G, N, P, S, T and V
  misc_feature (255)..(257): Xaa can be any naturally occurring amino acid
  MISC_FEATURE (258)..(258): Xaa can be any naturally occurring amino acid selected from A, C, F, G, H, I, K, L, M, R, T, V, W, Y
  misc_feature (259)..(260): Xaa can be any naturally occurring amino acid
  MISC_FEATURE (261)..(261): Xaa can be any naturally occurring amino acid selected from A, G and S
  MISC_FEATURE (262)..(262): Xaa can be any naturally occurring amino acid selected from I,L and V
  MISC_FEATURE (263)..(263): Xaa can be any naturally occurring amino acid selected from A, C, D, G, N, P, S, T and V
  misc_feature (264)..(264): Xaa can be any naturally occurring amino acid
  MISC_FEATURE (265)..(265): Xaa can be any naturally occurring amino acid selected from A, C, F, G, H, I, K, L, M, R, T, V, W, Y
  MISC_FEATURE (267)..(267): Xaa can be any naturally occurring amino acid selected from A, C, F, G, H, I, K, L, M, R, T, V, W, Y
  MISC_FEATURE (268)..(268): Xaa can be any naturally occurring amino acid selected from A, C, D, G, N, P, S, T and V
  MISC_FEATURE (269)..(270): Xaa can be any naturally occurring amino acid selected from A, C, F, G, H, I, K, L, M, R, T, V, W, Y
  MISC_FEATURE (271)..(271): Xaa can be any naturally occurring amino acid selected from A, C, D, E, G, H, K, N, Q, R, S and T
  misc_feature (272)..(272): Xaa can be any naturally occurring amino acid
  MISC_FEATURE (273)..(273): Xaa can be any naturally occurring amino acid selected from A, C, D, E, G, H, K, N, Q, R, S and T
  MISC_FEATURE (274)..(274): Xaa can be any naturally occurring amino acid selected from A, C, F, G, H, I, K, L, M, R, T, V, W, Y
  misc_feature (275)..(275): Xaa can be any naturally occurring amino acid
  MISC_FEATURE (276)..(276): Xaa can be any naturally occurring amino acid selected from A, C, F, G, H, I, K, L, M, R, T, V, W, Y
  misc_feature (277)..(278): Xaa can be any naturally occurring amino acid
  misc_feature (280)..(280): Xaa can be any naturally occurring amino acid
  MISC_FEATURE (282)..(282): Xaa can be any naturally occurring amino acid selected from A, C, D, G, N, P, S, T and V
  misc_feature (283)..(283): Xaa can be any naturally occurring amino acid
  misc_feature (286)..(286): Xaa can be any naturally occurring amino acid
  MISC_FEATURE (287)..(287): Xaa can be any naturally occurring amino acid selected from A, C, D, E, G, H, K, N, Q, R, S and T
  misc_feature (288)..(288): Xaa can be any naturally occurring amino acid
  MISC_FEATURE (289)..(289): Xaa can be any naturally occurring amino acid selected from A, C, F, G, H, I, K, L, M, R, T, V, W, Y
XXXXXXXXXXXXXXXWXXXXXXXXXXXXLXXDXXXXXXXXXXXXNETXTGVXSXXXXXXXXXXXXXXXXXXXXDXVSSXXXXXFXXXXWXXDXXXXGSQKGXMXXXGXXXXXXXXXXXXXXXXXXXXXXXXXXXXXXXXXXXXXXPXTPXXXXXXGXXXXXXXXXXXEXXXXXXXRHXXXAXXXRXXXXXWXXXXXAXXXXXXSXXXXXXXXPXXXXXXXXXXXXXXXXXXXXGXGXXXXXXXXFRXGHXGXXXXXXXXXXXXXXEXXXXXXXXXXXXGXGXXAAXXXX

SEQ ID NO: 666 - protein, 281 aa, Silicibacter pomeroyi DSS-3
  MISC_FEATURE (1)..(281): megaplasmid
MATEKRKRGRPKSFADKSEQNTNQSLDRAIDILECLASARGLALSEVAERLDLAPATVYRALHTFESRRLTEIDPETQTWHIGPDLFRLGSAFLLRSSLVERARPVLRKLMEVTGETANIGIERDGEILFLSQVETQSNIRAFFQPGTRAPLHASGIGKALLSQYDRARIDRLLPEMRLEQFTMKTRFDKEQLLSELDLIHRRGWALDDEERTHGMRCVAAPITDFTGEAIGGISVSGPSDRMPDARLTEIGNIVRDAALDLSRRLGAPLSVSIRPSTDEA

SEQ ID NO: 667 - protein, 280 aa, Silicibacter sp. TM1040
MDSQENASRATRRARGRPRDWHDKTAQNTIKSLDRAMEVFEYLSQAQGKPLTMIAEEMGQSPATVYRILVTLEGRGLVDFDAEEQLWHIGAQAFVIGARFLRRTSLVDRARPILRRLMEDTGETANLGVEKEGHVLFLSQVETHASIRAFFPPGTLSQMHASGIGKALLAEMDGSRLDRLLAATRLEIFTDHTITDPEALKADLAAIRAQGFAVDNEEKNAGMRCIAAPVFDMNREAIAGISVSGPTSRISVESIAELSRPVIEAAQQLTVAIGGDPAAL

SEQ ID NO: 668 - protein, 272 aa, Loktanella vestfoldensis SKA53
MQHDIRKTRGRPKAWDDKAVQNTVKSLDRALEVLIALGEMQGGTLSEIATNLHQSPATVYRVLTTFQGRGFVDFDRQAQVWSIGAAAFLTGSQFLRRTSLVERARPIMRDLMEATGETANLGIERDGNVLFLGQVETHATIRAFFPPGTVSAMHASGIGKALLAHMDDARQRRVLAAGKLEQFTPHTLTNPEAMIADLHAARARGYAFDGEERNLGMRCIAATVHDVSGDAVAGLSVSGPTSRITDDKIAPLAQAVTEAAARLTAAIGGAPR

SEQ ID NO: 669 - protein, 279 aa, Paracoccus denitrificans PD1222; identical to SEQ ID NO: 10
  MISC_FEATURE (1)..(279): chromosome 2

SEQ ID NO: 670 - protein, 285 aa, Roseobacter denitrificans OCh 114
MNTQKRPRGRPKSQFKESTAGTMQSLDRALGVLVAVAKSEQATLTDLSLSLGVPTATTHRILTTLQKHRFVAFNEEHQSWSIGIEAYRTGASFMNRTSLTEVSRPIMRLLMEKTGETANLAIPDGAEVVFVEQIETLHPIRAFFARGARTSMHASGIGKAILSTMSEEHVRRLLISSGLQAFTDNTLTSPASLFADLTETRARGYSYDREERYLGMSCIGSAIFDERGEACGGVSISGPSTRFDSLRVPELGAIVAEAAGQISQLIGGRGREPASSLPASNTPTA

SEQ ID NO: 671 - protein, 276 aa, Ahrensia sp. R2A130
  MISC_FEATURE (1)..(276): contig00014
MKMDIEARKRGRPRLFEGRDEDKVVRALDKGLVVLRVISESDGLSLSEIAETSEVSAPTAYRSLITMQMHGLVAFDDHTQLWRIDVEAFRVGSAFLSNSAVSEQARPVMQRLMESTGETSNLGILSDREVVFLSQAETHEPIRAFFRPGTRSPVHTSGIGKALLAFRPREEAQRLAEQLDMKPFTDNTICSADDLMKAVDEMVAQGFAVDDEERTLGMRCVAAPIFNSFGEAVAAISTSGPSVRVTKDRVLALGKQVRAAADEISRNIAGRIVDFS

SEQ ID NO: 672 - protein, 280 aa, Dinoroseobacter shibae DFL-12
MKDQTPSPRRSRGRPKNAFSDGQSSTIQALDRGLSVLSALARDGGGTLSDVSMRLGMPASTAHRVLATLEKHGYVDMDEASQTWRVGLEAFRVGTSFMQRTNLLEVGRASMRTLMEQTGETANLGILDNDHVVFIGQVETHNPIRAFHRPGSSGPMHASGIGKALLAAMPQGAVENLFRRTGLQQFSPKTLTDPEALLSDLRITRKRGWSFDNEERYEGMCCVAAVIYDSFREPIAGISVSGPSARFAPGALPALGAAVQTAARDVTAQIGGEMPQIAAE

SEQ ID NO: 673 - protein, 292 aa, Octadecabacter arcticus 238
MPDEPDSTVKHDHSRTQTRTQTRARGRPKAWRDKTEQNTIKSLDRALEVLSRLGDLEEATLSELANDLGQSPATIYRVLTTYRAHAFTDFDETRQVWSVGAGAFLTGAKFLRRTSMVERARPHLRRLMEATEETANLGVAKDADVLFLSQSETHHAIRAFFPPGTLSPMHASGIGKALLAQWPQKRVDAMLAARAPEQFTEYTLITRDALMDDLRETQLRGYSFDGEEKNIGMRCIAAPVFDVHGDAVAGLSISGPVARITDARIAPIGTLVRAGADALTRELGGVSPQPPG

SEQ ID NO: 674 - protein, 277 aa, Artificial Sequence
  synthetic peptide
  MISC_FEATURE (1)..(277): pDaep_A276
MPQAPRRKGRPKNFDSASNPPTIQSLDRALDVLDALAGASGMTLTELSTALDQSAATMYRVLATLEARQIVEMEPQSQTWHIGAMAFRLGSAFLRRSSVIERARPVMRELMEATGETSNLGIERGGDVMFVSQVETYESIRAFFPPGTTSPMHASGIGKALLSCFGEDQLTRFLRGRTLTEFTEKTLTSAEALREDLAQIRRRGWSFDDEEKAPGMRCVAAPVFGMQGEVLAGISVSGPTSRMPDTRISEIGALVRGAAEKLSYGLGAPAADQAAPG

SEQ ID NO: 675 - protein, 276 aa, Paracoccus sp. J56
MSVQVRKRGRPRGRAGGFGAEDSGGIRALDRALDILDLIAASNGLTLTEIAQRLEMAPSTVHRVLVTLAARGVAESDSQTQAWHVGPTAFRHGSAFMRRSGLVERARPLLRRLMEVTGETANLGILNGDAVLFLSQAETHETIRAFFPPGTRSALHASGIGKALLAHASMMDLKRMLREMRLERFTGMTLTDPQALLEDLARIRARGYALDNEERTPGMRCIAAPIFDLAGEAAAGISVSGPTLRMSDERLAAMSEAVIAAARELSFGAPPAADGG

SEQ ID NO: 676 - protein, 278 aa, Paracoccus aminophilus JCM 7686
MIHGKENQPRKRGRPRGSGNSQAEDKGGVRALDRALDLMDILASEQGMTLSEIAQRMGLAPSTVHRVLTTLDARAVVESDPLTQAWHLGPTAFRYGSAFMRRSGLIERSRPVMRRLMELTGETANLGIRNGNAVLFIGQVETHETIRAFFPPGTRSPLHSSGIGKALLAFVRPEVLRTFFHEAVLDRFTPTTLTERADLVADLTETRARGYSIDNEERSPGMRCIAAPIFDMFGEPVAGISVSGPSHRMTEARLSDIGSAVVEAARALSLSGPAEDNF

SEQ ID NO: 677 - protein, 269 aa, Rhizobium rhizogenes YR147
MPAEPRRRGRPKAFNGPQTQNTIQALDRALDVLDALATPEGKTLSELAGQLGQSAATMHRVLATLERREFVEISPDRQVWHIGPEAYRLGAAFLRRSNVVERSRPIMRELMLETGETSNLGIEKDGNVLFISQVETHESIRAFFPPGTLSPLHASGIGKALLSTYDDNRLSALFKKKEFERFTDNTVRSFDQLREELQKTRDRGYSFDDEERTKGMRCVAAPILNVHGEAVAGISVSGPIHRLPDADIHQIGERVKSAARMVSRRLGAP

SEQ ID NO: 678 - protein, 270 aa, Roseinatronobacter thiooxidans DSM 13087
MAETKPRGRPRAFHDKTEQNTVQSLDRALGILRVLSESSGLTLTELAQAAHQSPATVYRVLSTYQTHGMVELEAQGQRWHIGAGAFRIGSAFLRRTKLAERAREAMQTLMRESGETANLGVEEQDEVLFLTQVETHEAIRAFFPPGTRSPMHVSGIGKALLAYYPPARVARITALGLPGFTPASLTDAARLENDLTRTRARGYAIDNEERTEGMRCIAAPIFNAHAEPVAGLSISGPVFRLSLERAREMGELVRRAAAGVTEATGGRVPE

SEQ ID NO: 679 - protein, 281 aa, Citreicella marina DSM 26424
MEFQDNAARGPRKARGRPRDWEDKTAQNTIKSLDRAMEVFEFLSERQGIALSAIADDMGQSPSTIYRVLVTLEGRGLVEFDAEEQLWHIGPRAFMIGSRFLRRTSLVDRARPVMRALMEATGETANLGVEKEGKVLFLSQVETHANIRAFFPPGTLSAMHASGIGKALLAQMDDARLARRLEGGLDAFTEKTVTDRDRLMADLRQIRARGYSCDDEERNIGMRCIAAPVFDINGEAIAGLSVSGPTSRVTAEALHKLSRPVVEAARMLTEAIGGKVTPPRV

SEQ ID NO: 680 - protein, 275 aa, Ruegeria marina CGMCC 1.9108
MNTPKRARGRPRSAFSESGGATLQSLDRALGLLATVARFGHATLTDLALAQGLPAATAHRILTTLQKHGFVDFDRHSQEWMIGIEAYRTGSAYLRRAGLTEIGQPILRALMEKTGETANLAVPDGTEVVFIAQVETAHPIRAFFPAGTRSPMHASGTGKAILAMMPPERARTLLQKAGLPVFTSKTLSTPNALFQDLDRTRTRGWSYEADERHDGMSCIGAAIFDENGLPCAGISISGPSGRFKPDSLDRLGQAVAEAGAEITRLTGGTAPDRSS

SEQ ID NO: 681 - protein, 272 aa, Thalassobacter sp. 16PALIMAR09
MKSKRGRPKAFHDTTEQNTIQSLDRALHVVNYVAQSPDRSLTEIATALEQSPATVYRVLVTLAGHQMVEMDPAEQTWHIGAGAFRLGSAFLRRSSLVERARPVMRHLMERTGETANIGIEKNGRVLFLGQVETHESIRAFFPPGTQAPMHTSGIGKAILSHFGPERVHKIFESEAETYFTAHSLGTLDALTDDLALTRTRGFAVDNEERTLGMRCIAAPIFNSEGEAIAGLSISGPVVRISQDRVPEISRAVTEAAHKLTEAIGGPAIPVES

SEQ ID NO: 682 - protein, 268 aa, Salinihabitans flavidus DSM 27842
MPPKLRQRGRPKAFHDQTEKTRIQSLDRALDVLEALAAQGGQTLTEIAEDLGQSPATIYRILTTLEVRGMAEADPGDQTWHVGPGAFRLGSAFLRRASVVERARPVMRSLMESTGETANLAIEKGGKILFLSQVETHETIRAFSPPGTQSPLHASGIGKALLAFADPARIDGFLRDTLEAFTPKTITDPAAMRADLDRIRVCGYSFDDEERTEGMRCIAAPILNFYGEAVAGISVSGPTHRMREDRIEHLGALISRAAADLSRALGAP

SEQ ID NO: 683 - protein, 268 aa, Paracoccus alcaliphilus DSM 8512
MAEPTRRRGRPRSTTETSGTIQALDRALDILDLLAAHPGLTLSEVAEKMGQSPSTVHRVLHTLAARGVAESDTATQTWHIGPATFRLGSAFMRRSGIVERARPVLRTLMEHTGETANLGILNGDAVMFVSQAETHETIRAFFPPGTRSPLHASGIGKALLAFGRPETLQVLLQNGELQRFTDKTLTTREALTEDMARIRNRGFSFDDEERTRGMRCIAAPVFDLTGEAIAGVSVSGPTHRIGPEHVKTLGAVVAAAASELSAAMGADR

SEQ ID NO: 684 - protein, 267 aa, Paracoccus alcaliphilus DSM 8512
MWNESTQMEKTGTVQAVERALTLLELLAGFPQGARLTLLAKRAGLAPSTAHRLLTTLERRGFAQFDPAGSRWRVGRRAFTVGVAFTRWQSFITAATPFLRRLRDLSHETANLGVLEDGEVITVAQVESREIIRAIASPGGRAPVMNSGMGKAIVATWPDEAIEAFIHRHGLHPVTRHSLTTLTEVMAEIALIRRRGYAFDDEEFIYGMRCAAAAVWDHSGQPVGAISVSALASRLPVAGMAEMGKAVRGVAGELSLTMGGKPPPIPA

SEQ ID NO: 685 - protein, 251 aa, Paracoccus sp. PAMC 22219
MADPTRRRGRPCNDGPDRPLTVQALDRALDMLDLLSLHPGLTLSEVAQRTGLPASATHRILQTLALRGMVERCDATQCWAVGPSSFRLGAAFLRRSGLIARARPILQALVARTGETANLGILSDDGVLFVAQVESDQPIRVAFPPGTRACLHASGIGRAMLAVNARTAPEGLCRDLARIRRRGFAFDDQGRMAGMRCVAAPIVDLSGRAVAGLSINAPAHRIGGRQVTAIGAAVAEAAARLTAVTGEQLHL

SEQ ID NO: 686 - protein, 281 aa, Paracoccus sp. PAMC 22219
MQQPVRKRGRPRGGKADQPAASIQALDRGLDVLEALAAHEGITLTGLSTHLDQSPATMHRVLATLEHRRYVENNPDRQEWFIGPEAFRLGSAFLRRTNIAERSRAVMRDLMAQAGETANLGIERDGDVLFVSQVETHQTIRAFFPPGTRSPLHASGIGKALLAAFDPTRLAVVMRVAPFTRFTDKTIADADALHAEIALIRRRGFAVDDEERTLGMRCVAASIVNSYGEAVAGVSVSGPTNRMTDAAVDRIGGMVATAAAQISANLGSGQGGPGGRIPLTP

SEQ ID NO: 687 - protein, 266 aa, Paracoccus sp. PAMC 22219
MADPTRKRGRPRKTLPDAPGTVQSLDRALDLLDLLAAQPGLTLSEVAERSAQPPSTVHRVLHTLAARGMAESDPATQAWNIGPQAFRLGSAFMRRSGLVERARPIMRALMEHTGETANLGILQGDSVLFLSQVETSETIRAFFPPGTRSPLHASGIGKALLAFRPDSVAALGPLARFTDTTLTDPEALEADLARIRHRGFSFDDEERSRGMRCIAAPVFDLSGEAIAGISVSGPTHRIGAEHVKTLGAVVAAAAASLSDALGGPTP

SEQ ID NO: 688 - protein, 275 aa, Loktanella sp. 5RATIMAR09
METEVKRGRGRPKAWDDKGAQNTIKSLDRALEVLVQLGEMQGSTLSEIAGALGQSPATVYRVLTTFQGRGFADFDPQSQVWSIGPAAFLTGSMFLRRTSLVERARPIMRDLMEATGETANLGIERDGQVLFLGQVETHATIRAFFPPGTASAMHSSGIGKALLSRMDDKRQRAVLAAGKLEQFTPHTLTDPEAMIADLHATKARGYAFDGEERNIGMRCIAAPVYNVFGEAVAGISVSGPTSRITDDRIVALAEDVMEAATRLTRAIGGNHRPAS

SEQ ID NO: 689 - protein, 279 aa, Octadecabacter temperatus SB1
  MISC_FEATURE: null replaces 100945
  MISC_FEATURE (1)..(279): null replaces 100945
VSDNPISSATRARGRPKAWTDKTDQNTIKSLDRALQILSRLGDMEEATLSELSSALSQSPATVYRVLTTFQAHDFTEFNPTRQVWSVGAGAFLTGAKFLRRSSMVERARPHLRRLMEATEETANLGIAKGANVLFLSQSETHHAIRAFFPPGTVSPMYASGIGKALLALWSEKRVNALLAAQKIEQFTEHTLTDAAALTADLAETRARGYSFDAEEKNIGMRCIAAPVFDIYGEAIGGLSISGPVARITDNRISDIGAIVRSEANALTRTLGGVPPTEV

SEQ ID NO: 690 - protein, 271 aa, Leisingera sp. ANG-S
MSQPPRRKGRPKSFDSASQPATIQSLDRALDVLDALAGASGMTLTELSSALDQSAATMYRVLATLEARRIVEMEPQSQTWHIGAMAFRLGSAFLRRSSVIERARPVMRELMEATGETSNLGIERGGDVMFVSQVETHESIRAFFPPGTTSPMHASGIGKALLSCFGEDQLARFLRGRTLERFTEKTLTSAETLRADLAQIRNRGWSFDDEEKAPGMRCVAAPVFGMQGEVLAGISISGPTARMPDGGIYGIGTLVKDAAQKLSQGMGAPAA

SEQ ID NO: 691 - protein, 269 aa, Sinorhizobium fredii CCBAU 83753
MQPAKRRRGRPKGFNAPESQTVIQSLDRALDVLEAVAWPEGLTLSELAAHLGQSAATMHRVLATLERREFVEISPDRQVWHIGPEAYRLGSAFLRRTNVVERSRAIMRELMLETGETSNLGIEKDGNVLFISQVETHESIRAFFPPGTLAPLHASGIGKALLSTYDDSRLASLFQKATLERFTENTVRSFAQLKEELRATRDRGYAFDDEERTQGMRCVAAPILNVHGEAVAGISVSGPTHRMPDKRVQQIGERVRSAAKTVSRRLGAP

SEQ ID NO: 692 - protein, 282 aa, Sinorhizobium fredii CCBAU 83753
VTEYSAVAVVSEQTKGKRGRKAGANSTPSSVQVLDRSLALFSLVADRDGSTLTDLADETGLAPSTIHRLLTSLSSHGMVAHDPDTGEWTIGVRAFEIGNAFLRFRKLGTISRPFLKRLMEESGETANIGIEDDGDVVFISQVESHAPMRAFFRPGRRGPSHASGIGKAILSTWSDTEIAKTLGGKTLTHFTDRTLKTLPALIRNIQEIRNRGWSIDDEEHTLGMRCIAAPLFNEYGEAIGGISISGPSVRIDDDRLETLGSLVRRTADELTRAIGGHRPGES

SEQ ID NO: 693 - protein, 282 aa, Defluviimonas indica DSM 24802
MKSQANASGGGRRARGRPRGWDDKTAQNTIKSLDRAMEVFEYLSEAQGKPLTMLADEMGQSPATVYRILVTLEGHRLVEFDHEEQVWHIGTGAFVIGARYLRRTSLVDRARPIMRKLMEATGETANLGIEREAAVLFLSQVETHANIRAFFPPGTLSPMHASGIGKALLAHMDEDRLDRLLARTDLQAFTEHSITDRSALKEDLKTIRARGFSVDNEEKNLGMRCIAAPVFDMNKEAVAGISVSGPTHRVDEAEIERLSSAVIGAAHQLTLAIGGGATEPRS

SEQ ID NO: 694 - protein, 244 aa, Oceanicola flagellatus CGMCC 1.12644
MEVFEFLSEAQGKTLSALAGDLEQSPATVYRILVTLEVRGLVEFDQADQVWHIGPRAFLIGARFLKRTSLVDRARPLLRQLMEATGETANLGIEQNGNVLFVSQVETNASIRAFFPPGTLSRLHASGIGKALLSQMDDHRINRFLDRGPLEKFTEYTLTERSALIADLATTRARGYAIDGEERNLGMRCIAAPVFDIHDEAIAGISVSGPTTRVTPEEIERLSVAVLTASHKLTAAIGGATPDH

SEQ ID NO: 695 - protein, 269 aa, Phaeobacter inhibens S4Sm
MPQEKRKRGRPKSFKDNPEQNTNQSVDRAFDILEILATTPGLSMTDIADRVRMSPATAYRILNTLQKRRLTDLDPENQTWHVGSELFRLGSAFLNRSSLVERARPVMRNLMEVTGETANIGIEREGEILFLSQVETHANIRAFFQPGARAPLHASGIGKALLSRFDRARVDKLIPQDRLEQFTMKTIFDKTRLFEELDHINRQGWALDDEERTQGMRCIASPVIDHLGEAIGGISVSGPSARMPDEKLVAMGNAVRKAASDLSNRLGAP

SEQ ID NO: 696 - protein, 283 aa, Brevirhabdus pacifica DSM 27767
MANEHTRDAARPRGRPKAFNDATPQNTIKSLDRALHVLAELARMENATLTGLAQELSESPATVYRVLTTFQGHGIVDIDEAAQTWHVGPNAFLIGSGFLRRTSLIERSRPVLRKLMEATGETANLGIENDGEVLFVSQVETHASIRAFFPPGTKSPAHASGIGKALLAHFPKDRLDRVLSRELQGFTPHTLTRPEALLSDLEAIRARGYSVDNEERNEGMRCIAAPIRNTYGETIAGISVSGPTSRVGPDQVEALALSVREAAEEVSASLGAKASLPTAGKAG

SEQ ID NO: 697 - protein, 282 aa, Methylobacterium radiotolerans SB3
MDTGNRRRGRPKGFGGAKPTATIQALDRALDVLDVLAGGDGLTLSELAGRLEQSVATMHRVLATLERRGLVEISADKQEWHVGAEAYRLGSAFLRRHNVVERSRSMMWTLMQETGETSNLGVEKDGNVLFVSQVETHETIRAFFPPGSLSPLHASGIGKALLSTYAPARTERLFRGRTFARFTDKTIGSLDQLRDDVEATRRRGYAIDDEERSIGMRCVAAPILNVHGEAIAGISVSGPTHRLSDEKLRAIGERVRRGAAAVSRALGAPAATTEAPDEPDRD

SEQ ID NO: 698 - protein, 280 aa, Pelagimonas varians DSM 23678
MDSQDNAASPAKRARGRPRDWDDKTAQNTIKSLDRAMEVFEYLSEGRGKALTAISSEMGQSPATVYRILVTLEGRGLVEFDRFEQVWNIGPRAFVIGARFLRRTSLVDRARPIMRKLMEATGETANLGIEKEGAVLFLSQVETHASIRAFFPPGTLSPMHASGIGKALLAQMDEARLGRTLAGQTLDAFTPYTITDPAELRVGLEAVRAQGYALDGEEKTLGMRCIAAPVFDVNQEAVAGISVSGPISRVGPEDIDRLSAFVIKAARDLSSAIGGEMAQR

SEQ ID NO: 699 - protein, 278 aa, Thalassobius mediterraneus 5120
MSDEIRRKGRPKAFSADPKASTIQALDRAFDVLDVIAAHSGLTLSEIATALDQSPATMHRVLATLEARQVVETDPVRQTWHIGAAAFRLGSAFLRRSSVVERARPVMRALMEETGETSNLGIERNSEVMFLSQVETHESIRAFFPPGTLSPMHASGIGKALLAAMPEDAVSKRLRHLTLERFTDKTILTTAELQADLVQIQRRGWAFDDEEKALGMRCVAAPIRNLHGEPVAGLSISGPVQRLPLDRIEHIGARVRAAAQQLSQDLGAPDGPNGSPTG

SEQ ID NO: 700 - protein, 261 aa, Thalassobius mediterraneus 5120
MAERQTNGVQSVQRALALLERVAEAQCGARLTDLARDAGLAASTVHRLLTTLEQSGFVHADAASGRWHVGQRAFAVGAAYTKQRSFVAPALPFLKRLRDTTRETANLGVIEDGEVVTLSQVESREIMRAISPPGGRVPVMCSGMGKAILATWEDAAIDRAIERHGLRALTKRSLTSPKAVHAEIANIRQRGYALDDEEFVIGLRCVAAVVWGPAGEPACAISVSGLAARMTPEKVTQTGATVQRLAAELTEVLGGKPPESS

SEQ ID NO: 701 - protein, 284 aa, Jannaschia sp. CCS1
MSMASSSTPPASGPSRRARGRPRGWDDKTAQNTIKSLDRAMEVFEHLSATRGATLSVLAKDLDQSPATVYRILVTLEGRGLVEFDPTAQHWHIGARAFVIGARYLRRTSLVDRARPVMRRLMEITGETANLGVARDTHVLFVSQVETHASIRAFFPPGTLSPMHASGIGKALLAQMSDDRLSRLIATAPLDQFTSRTLTEPATLRADLEATRERGYSIDDEEKNEGMRCIAAPVLDFSGEAVAGISVSGPVSRISVAQTEEIAQAVMAAAAELSTAMGAERPRS

SEQ ID NO: 702 - protein, 269 aa, Mesorhizobium sp. BNC1
MQLPVRRRGRPKSGRNEPPGSNIQALDRALDVVEALASHDGMTLTELSDHLRQSAATMYRVLSTLERRQYVEINPERQEWFIGPEAFRLGSAFLRRTNIVESSRSIMRDLMARTGETSNLGIERDGDVLFVSQVETHETIRAFFPPGTRSPLHASGIGKALLSAFDDERLEAFINRARFIRFTDKTVANADQLREAVRQTRGQGYSLDDEERTIGMRCVAAAIFNSYGEAVAGISVSGPTIRLPDSKVREIGQWVVEAANEISRRLGAR

SEQ ID NO: 703 - protein, 280 aa, Roseovarius sp. TM1035
MTQTKRARGRPKSQFADSSAGTMQALDRALSVLTAVARQEGVNLTDLSLSLGIPTATTHRILTTLQKRDFVRFDEERQDWTIGIEAYRTGVAYLKRTNLADAGRPVMRRLMEQTGETANLAVPDGAEVVFIGQVETQNPIRAFFPPGSRTPMHASGTGKAILAALPEDRLMALLKGAGLKGFTEETLITPRALFDDLAETRTRGWSFDRNERYDGMSCIGAAIFNDRGEPCAGVSISGPSSRFRDAQISEFGAAVAQAAVQITHLIAGKGVLISETTGSR

SEQ ID NO: 704 - protein, 282 aa, Methylobacterium radiotolerans JCM 2831
  MISC_FEATURE (1)..(282): plasmid pMRAD01
MDTGNRRRGRPKGFGGAKPTATIQALDRALDVLDVLAGGDGLTLSELAGRLEQSVATMHRVLATLERRGLVEISADKQEWHVGAEAYRLGSAFLRRHNVVERSRSMMWTLMQETGETSNLGVEKDGNVLFVSQVETHETIRAFFPPGSLSPLHASGIGKALLSTYAPARTERLFRGRTFARFTDKTIGSLDQLRDDVEATRRRGYAIDDEERSIGMRCVAAPILNVHGEAIAGISVSGPTHRLSDEKLRAIGERVRRGAAAVSRALGAPAATTEAPDEPGRD

SEQ ID NO: 705 - protein, 308 aa, Rhizobium sp. NGR234
  MISC_FEATURE (1)..(308): plasmid pNGR234b
MEIREGAIRRGTGQSRVSPLLASERVVTGYLAVAVVSEQTKGKRGRKAGANSTPSSVQVLDRSLALFSLVADRDGSTLTDLADETGLAPSTIHRLLTSLSSHGMVAHDPDTGEWTIGVRAFEIGNAFLRFRKLGTISRPFLKRLMEESGETANIGIEDDGDVVFISQVESHAPMRAFFRPGRRGPSHASGIGKAILSTWSDTEIAKTLGGKTLMHFTGRTLDTVPALIRNIQEIRNRGWSIDDEEHTLGMRCIAAPLFNEYGEAIGGISISGPSVRIDDDRLETLGSLVRRTADELTRAIGGHRPGDG

SEQ ID NO: 706 - protein, 269 aa, Rhizobium sp. NGR234
  MISC_FEATURE (1)..(269): plasmid pNGR234b
MQVANRRRGRPKSFNGPQSQSVIQSLDRALDVLEALALPEGMTLSELAAHLGQSPATMHRVLSTLERRELVEISPDRQVWHIGPEAYRLGSAFLRRTNIIERSRPIMRDLMLETGETSNLGIEKDGNVLFVSQVETHESIRAFFPPGTLSPLHASGIGKALLSTYDDNRLVSLFKKTTLERFTENTVRSLAQLEDELRVTRDRGYALDDEERTKGMRCVAAPILNVHGEAVAGISVSGPTHRMPDRQVHQIGERVRDAAKMVSRRLGAP

SEQ ID NO: 707 - protein, 292 aa, Citreicella sp. SE45
  MISC_FEATURE (1)..(292): genomic scaffold scf_1113211290443
MNVAFKKNERDFMDSPKDAETSPRRARGRPRGWEDNSAQNTIKSLDRAVEVLEYLSSRPGLTLSELAGDLDQSPATVYRILVTLEGRRLVEFDPTEQLWHIGPQAFVIGARFLRRTSLVERARPILRGLMEETGETANLGIVREASVLFVSQVETHESIRAFFPPGTLSPLHASGIGKALLAEMPGERLEKLRVRPMERFTPHTLASPEALLNDLAAIRERGYSIDAEERNLGMRCIAAAVFDASGEAVAGISVSGPTIRMGEESTHEASRAVMRAARELTAAIGGVRPPVR

SEQ ID NO: 708 - protein, 277 aa, Artificial Sequence
  synthetic peptide
  MISC_FEATURE (1)..(277): pCaer_C109
MPPSPRRKGRPKSFDSASQPPTIQSLDRALDVLDALAGASGMTLTELSTALDQSAATMYRVLATLEARQIVEMEPQSQTWHIGAMAFRLGSAFLRRSSVIERARPVMRELMEATGETSNLGIERGGDVMFVSQVETHESIRAFFPPGTTSPMHASGIGKALLSCFGEDQLTRFLRGRTLEQFTDKTLTSADTLREDLAQIRSRGWSFDDEEKAPGMRCVAAPVFGMQGEVLAGISVSGPAARMPDARINDIGALVRGAAEKLSYGLGAPPAEQSPPG

SEQ ID NO: 709 - protein, 269 aa, Ensifer fredii USDA257
MQVVKRRRGRPKAFNAPESPSVIQSLDRALDVLEALASPEGLTLSELAAHLGQSAATMHRVLSTLERREFVEISPDRQVWHIGPEAYRLGSAFLRRTNVVERSRPIMRELMLETGETSNLGIEKDGHVLFISQVETHESIRAFFPPGTLSPLHASGIGKALLSTYDDSRRTSLFKKSTLERFTENTVRSIAQLEEELRVTRDRGYAFDDEERTKGMRCVAAPILNVHGEAVAGISVSGPTHRMPDRQVQKIGERVRNAATKVSRRLGAP

SEQ ID NO: 710 - protein, 276 aa, Ensifer fredii USDA257
MAVVSEQTKGKRGRKAGANSTPSSVQVLDRSLALFSLVADRDGSTLTDLADETGLAPSTIHRLLTSLSSHGMVAHDPDTGEWTIGVRAFEIGNAFLRFRKLGTISRPFLKRLMDETGETANIGIEDDGDVVFISQVESHAPMRAFFRPGRRGPSHASGIGKAILSTWSDTEIAKTLGGKTLTHFTDRTIDTLPGLIRNIQDIRNRGWSIDDEEHTLGMRCIAAPLFNEYGEAIGGISISGPSVRIDDNRLEALGSLVRRTADELTRAIGGHRPGES

SEQ ID NO: 711 - protein, 279 aa, Paracoccus pantotrophus J46 ICCP
MSVQIRKRGRPRGRAGGLGAEDSGGIRALDRALDILDLIAVSSGLTLTEIAQRLDMAPSTVHRVLVTLAARGVAESDSQTQAWHVGPTAFRHGSAFMRRSGLVERARPLLRRLMEVTGETANLGILNGDAVLFLSQAETHETIRAFFPPGTRSALHASGIGKALLAHARPADLKRMIREMRLERFTEMTLTDPQALLDDLACIRARGYALDNEERTPGMRCIAAPIFDLAGEAAAGISVSGPSLRMSDARLEAMSEAVIEAARELSLGMAPASRAGESG

SEQ ID NO: 712 - protein, 276 aa, Paracoccus sp. J4
MSVQIRKRGRPRGRAGGFGAEDSGGIRALDRALDILDLIAMSNGLTLTEIAQRLEMAPSTVHRVLVTLAARGVAESDSQTQAWHVGPTAFRHGSAFMRRSGLVERARPLLRRLMEVTGETANLGILNGEAVLFLSQAETHETIRAFFPPGTRSALHASGIGKALLAHARPADLKRMIREMALERFTPMTLSDPQALLDDLARIRARGYALDNEERTPGMRCIAAPIFDFAGEAAAGISVSGPTLRMSDARLEAMAEAVIAAARELSFGMAPPAAEG

SEQ ID NO: 713 - protein, 279 aa, Paracoccus sp. N5
MSAELRKRGRPRGRTAGAGAEDSGGIRALDRALDILDLIASSSGLTLSEIGQRLDMAPSTVHRVLVTLAARGVAETDPATQAWHVGPTAFRHGSAFMRRSGLVERARPLLRRLMEQTGETANLGILNGDAVLFLSQAETHETIRAFFPPGTRSALHASGIGKALLAHVRPAQLRLMLQGMALQRFTDKTLTEAQALEQDLARIRARGYSLDNEERTPGMRCIAAPIFDLSGEAAAGISVSGPTLRMSDARLEAMSEAVIAAARELSFGMTPARGTGGES

SEQ ID NO: 714 - protein, 280 aa, Roseovarius mucosus DSM 17069
MTQTKRARGRPKSQFADSSAGTMQALDRALSVLTAVARQEGVNLTDLSLSLGIPTATTHRILTTLQKRDFVRFDEERQDWTIGIEAYRTGVAYLKRTNLADAGRPVMRRLMEQTGETANLAVPDGAEVVFIGQVETQNPIRAFFPPGSRTPMHASGTGKAILAALPEDRLMALLKGAGLKGFTEETLITPRALFDDLAETRARGWSFDRNERYDGMSCIGAAIFNDRGEPCAGVSISGPSSRFHDAQISEFGAAVAQAAAQITHLIAGKVVAISETAGSR

SEQ ID NO: 715 - protein, 269 aa, Ensifer sp. USDA 6670
MQVVKRRRGRPKAFNAPESPSVIQSLDRALDVLEALASPEGLTLSELAAHLGQSAATMHRVLSTLERREFVEISPDRQVWHIGPEAYRLGSAFLRRTNVVERSRPIMRELMLETGETSNLGIEKDGHVLFISQVETHESIRAFFPPGTLSPLHASGIGKALLSTYDDSRLTSLFKKSTLESFTENTVRSIAQLEEELRVTRDRGYAFDDEERTRGMRCVAAPILNVHGEAVAGISVSGPTHRMPDRQVQKLGERVRNAAMKVSRRLGAP

SEQ ID NO: 716 - protein, 273 aa, Ensifer sp. USDA 6670
MEANGKGKRGRKAGENAAPASVQVLDRSLSLLAIIAEGDGSTLTALSERSGMAPSTVHRLLTSLAQHGMVANDAEAGTWTVGVKAFEIGNAFLRFRKLGTISRPFLKRLMDESGETANIGVEEDGDVVFISQVESHAPMRAFFRPGRRGPIHASGIGKAILSTWSDTEIAKTLSGRTLACFTGRTLATLPDLIRNVQEIRFRGWSVDDEEHTLGMRCIAAPLFNEYGEAIGGISISGPTVRIDNERLGVLGPAVRRTADELTRAIGGHRPEEG

SEQ ID NO: 717 - protein, 269 aa, Rhizobium etli CNPAF512
MTVPVRRRGRPKGFNDPQTQNVVQSLDRALDVLEALASPEGMTLSELAKHLGQSAATMHRVLATLERRDYVEMSPDGQIFHIGPEAYRLGAAFLRRTNVIERSRPVMRELMLETGETSNLGIEKNGKVLFVSQVETHESIRAFFPPGTLSPLHASGIGKALLSTYDEERFGALFKGTTLQRFTANTLRTVDQLREELEITRQRGYAFDDEEKAAGMRCVAAPVLNVHGEAVAGISVSGPAHRMPDRQVKRIGQRVIEAARLVSNRLGAS

SEQ ID NO: 718 - protein, 275 aa, Sulfitobacter sp. 20_GPM-1509m
MVSQDNPPSEPRRARGRPRDWSDKTAQNTIKSLDRAMEVFEFLSEHQGKALTTLASETDQSPATVYRILVTLEGRGLVEFDAVEQLWHIGPRAFVIGARFLRRTSLVERARPVMRRLMEQTGETANLGIERGGQVLFVSQVETEATIRAFFPPGTLSPMHASGIGKALLAEMDDARLQRALAGKELTAFTPYSITHLDALRADLEQVRARGYAVDAEERNIGMRCIAAPVFDIHQEAVAGISVSGPTSRVGLEDIERLSEAVRAAARDLTATLGG

SEQ ID NO: 719 - protein, 280 aa, Maribius sp. MOLA 401
MAGNDAVSGRRSRGRPRSWDDKSAQNVIKSLDRAMEVFAYLGQSGGVTLTELAHDLDQAPATIYRILVTLERHDLVEFDAQDQDWHIGSNAFLIGSRFLRRTSLVDRARPIMRTLMERTGETANLGVERAGQVLFVSQVETHANIRAFFPPGTLSRFHASGIGKVLLAWMPEDRRRALIEGAPLERFTPHTIVRTDMLIRDLQAARERGYAIDAEERTLGMRCIAAPVFDVHGEVRAGLSVSGPTSRIDAAAIAGLGRAVTDAAAALTAALGGASIPPPP

SEQ ID NO: 720 - protein, 275 aa, Rhodobacteraceae sp. HL-91
MTQLSRRGRPRAFHDKTAQNTIQSLDRAMAILETLAQSEGMTLSTLASACGQSTATVYRVLITLQQREMVDLDPAGQVWHVGVGTFRAGTSFLRRTSLVERARAPMQALMRDSGETANLGVEQQDEVLFLTQVETHQAIRAFFPPGTIGPMHVSGIGKALLAWFDDARVAQVVARRGLQAFTPASLTSLDALQADCARTRARGFAFDDEERAPGMRCIAAPIFNPHGEPVAGVSVSGPAFRLEAGNLDRIGALVVETAARITAATGGVAPAAKAV

SEQ ID NO: 721 - protein, 286 aa, Methylobacterium sp. UNCCL143
MDSGNRRRGRPKGFGGAKPAATIQALDRALDVLDVLAGGDGLTLSELAGRLEQSVATMHRVLATLERRGLVEISADKQEWHVGAEAYRLGSAFLRRHNVVERSRSMMWTLMQETGETSNLGVEKDGNVLFVSQVETHETIRAFFPPGSLSPLHASGIGKALLSTYAPARTERLFRGKTFARFTDKTIGSLDQLRDDVEATRRRGYAIDDEERSIGMRCVAAPILNVHGEAIAGISVSGPTHRLSDEKLRAIGERVRRGAAAVSRALGAPAATMTATPDAPGEPDQD

SEQ ID NO: 722 - protein, 280 aa, Aquisalimonas asiatica CGMCC 1.6291
MADDRERRRKRGRPRSDRPQDATGTVQALDRGLRLLALLAEQDEMTLTEIGLDAGIAPTTAYRLLVTLQQRDMVTFDEEAQTWSIGVETFRIGSAFLRRTNYLEAGRPVMRRLMEASGETSNMAIQDGSDVVFVSQIETHKPIRAFFRPGTRGHMHASGIGKALLAERSEQDVRAIITEKGLPAFTDTTLTTADALFADLARTRERGWAVDDEESTTGMRCLAAPVFNEYGEAIAGISISGLAVRLPDTVLDTLGPLVRDAADEVTDNIGGLLPARMATD

SEQ ID NO: 723 - protein, 275 aa, Roseovarius lutimaris DSM 28463
MTPPKRARGRPKSQFGESSAGTMQSLDRALSVLVAVAREDRATLTDLSLALGIPTATTHRILTTLQKRDFVRFDDERQDWSIGIEAYRTGVAFLKRTNLSDVGRPVMRRLMEQTGETANLAVRDGAEVVFIGQVETQNPIRAFFPPGSRTPMHASGTGKAIMAALPKDRLLSLLKGAGLKGFTEQTHVTPKALFDDLAKTRARGWSFDRNERYDGMSCIGSAIFNDRGEPCAGVSISGPSSRFSDAQIAEFGAAVAQAAAEITHLIAGQSVDTTG

SEQ ID NO: 724 - protein, 265 aa, Roseovarius lutimaris DSM 28463
MERYTEVTTPKTEGVQSVVRALRLLKLLSLNDEGLRVSDIARQAGLAVSTTHRLLTTLERQNFAQFEPDRALWHVGREAFAVGAAFGRRHNFVAPALPYLRRLRDLTRETANLGILDQDELVTISQVESREIMRAISPPGGRVPTFCSGMGKAILATWEDADIAAFVARTGFHPMTKRSHRDMTTAMVDIKRIRSRGYALDDEEHVTGLRCLAAVVWSAQGEAVCAISVSGLAARLPDARLDAIGKQVAEAARELTQKLGGAPPG

SEQ ID NO: 725 - protein, 277 aa, Halocynthiibacter sp. PAMC 20958
MKTQDDKNQGPRKPRGRPRDWHDKTAQNTIKSLDRAMEVFEFLSDTQGKALTTLASDLNQSPSTVYRILVTLEARGLVEFDQVDQVWHIGARAFVIGSRFLRRTSLVERARPHLRALMEKTGETANLGIRQHGRVLFVSQVETDATIRAFFPPGTLSRLHASGIGKALLAEMDPDRIEKLISDEPLERFTEFTLTDRDALKEDLRITRERGYSLDGEERNLGMRCIAAPVFDIHGEALAGISVSGPTSRVGVEQIPELSEAVLVAARDLSASIGGKS

SEQ ID NO: 726 - protein, 271 aa, Leisingera sp. ANG-S3; identical to SEQ ID NO: 690

SEQ ID NO: 727 - protein, 267 aa, Paracoccus saliphilus DSM 18447
MAEPTRKRGRPRKDAPETSGTIQALDRALDMLDLLAAHPGLTLSEVAEQMKQSPSTVHRVLHTLAARGVAESDPATQTWHIGPATFRLGSAFMRRSGIVERARPILRTLMEHTGETANLGILNGDAVLFVSQAETHETIRAFFPPGTRSPLHASGIGKALLAFGRPEILRMLLDKAELPRFTDKTLTTAEALQEDTIRIRARGFSFDDEERTRGMRCIAAPVFDLTGEAVAGLSVSGPTHRIGHEHVKTLGAAVAASAQELTQALGG

SEQ ID NO: 728 - protein, 275 aa, Rhodovulum sulfidophilum DSM 1374
MTQPRPRGRPRAFHDKTDQNTVRALDRAMGLLTALSETKGLTLSELAALSNQSPATVYRVLITLQGHDIVELEEEAQRWHVGPGAFRIGSGFLRRTNVAERSRGAMQALMRATGETANLGVEDRDEVLFLTQVETHETIRAFFSPGTRGPMHCSGIGKALLAFLPAARVAAILKTQGLPGFTPRSITSETGLHADLDRTRARGYAIDDQERAEGMRCIAAPIFNAHGEPIAGLSVSGPAFRIPLDAADGIGAEVRAAADRVTAATGGISPTEKSA

SEQ ID NO: 729 - protein, 282 aa, Litoreibacter ascidiaceicola DSM 100566
MDSKNNAGISHRKARGRPRDWDDKSAQNTIKSLDRAMEVFEFLSEAQGKTLTMLATDLSQSPATVYRILVTLEGRGLVEFDQDDQVWHIGPRAFVIGARFLRRTSLVERARPVLRSLMEDTGETANLGIEQNGHVLFVSQVETTASIRAFFPPGTLSRMHASGIGKALLAEMEEQRIRKLLSKAPLEGFTEFTLTDHTALLEDLHLSKARGYAIDGEERNLGMRCIAAPVFDIHGEAIAGISVSGPTTRVGAEQVAALSEAVVAAASRLTVAIGGAPPPAQG

SEQ ID NO: 730 - protein, 275 aa, Roseovarius marisflavi DSM 29327
VTPPKRGRGRPKSQFSESSAGTMQSLDRALSVLVAVAREDRATLTDLSLALGIPTATTHRILTTLQKRDFVRFDDERQDWSIGIEAYRTGVAFLKRTNLSDVGRPVMRRLMEQTGETANLAVRDGAEVVFIGQVETQNPIRAFFPPGSRTPMHASGTGKAILAALPEDRLLTVLKGAGLKEFTEHTHVTPKALFADLEKTRARGWSFDRNERYDGMSCIGSAIFNDRGEPCAGVSISGPSSRFSDAQIAEFGAAVAQAAAEITHLIAGQLVEVKA

SEQ ID NO: 731 - protein, 265 aa, Roseovarius marisflavi DSM 29327
MERYTEVINPKTEGVQSVARALRLLKILSQNDEGLRVSDIARQAGLAVSTTHRLLTTLELQNFSQFEPDRALWHVGREAFAVGSAFGRRHNFVAPALPYLRRLRDLTRETANLGILDHDELVTISQVESREIMRAISPPGGRVPTFCSGMGKAILATWQDADIAAFVARTGFHPMTKRSHRNLTTAMVDIKRIRAQGYALDDEEHVTGLRCLAAVVWSAQGEAACAISVSGLAARLPESRLDAIGKQVADAARELTQKLGGTPPA

SEQ ID NO: 732 - protein, 273 aa, Rhodovulum sp. ES.010
MTQARPRGRPRAFHDKTEQNTIQSLDRAMALLRALAKTNGLTLTELADRSGQSAATVYRVLVTLQGHEIVEFEEGAQRWHVGAGAFRIGSGFLRRANVAERSRGAMQALMRATGETANLGVENRDEVLFLTQVETHEAIRAFFPPGTRSPMHVSGIGKALLAYYPEARVAGIVAEKGLAGFTSLSITSEASLSRDLARTRERGFAIDDQERAEGMRCVAAPIFNAHGEPVAGLSVSGPAFRMTLSEAARMGQEVRKAADSVTAAIGGTPHGQA

SEQ ID NO: 733 - protein, 279 aa, Ruegeria sp. P4
MDSQENAPKATRRARGRPRDWHDKTAQNTIKSLDRAMEVFEFLSEAQGKPLTMIAEEMGQSPATVYRILVTLEGRGLVEFDTEEQLWHIGARAFVIGARFLRRTSLVDRARPILRKLMEETGETANLGIEKEGHVLFLSQVETHASIRAFFPPGTLSQMHASGIGKALLAQMESSRLDRLLATTRLEVFTDHTITDHEALKQDLTAIRAQGFAVDNEEKNAGMRCIAAPVFDMNREAIAGISVSGPTSRISAQEITQLSRPVIEAARALTLAIGGDVAS

SEQ ID NO: 734 - protein, 274 aa, Jannaschia rubra CECT 5088
MDFQDNPVRRARGRPRAFDARTEQNTIKSLDRALMVLDELSHMESASLSELAQGLEESPATVYRILSTFALHGVVEVDAAQQTWHIGADAFRIGSAFLRRTSLVERSRAVLRGLMKTTGETANLGVEKDGAVLFVSQVETHAPIRAFFPPGTLSPLHASGIGKVLLAHAPAGRLEQVAAKGLESFTPHTLADLGRLRADLDLIRARGHAVDDQERNLGMRCIAAPIRNVHGEVVAGISVSGPTSRVSPDHVPDLARAVIAAAAEVSAAIGAPGG

SEQ ID NO: 735 - protein, 277 aa, Ruegeria atlantica CECT 4292
MNETKKPLRRGRPRLKANEEKAEVSLVVALDRGIQVLIFLADRRCATLAELAKVTAIPAATAHRLLTTLQQRGMVVHDAEKGKWRIGPQSYRIGSTFEEGSNLLEVAPAEMRILSEETGETANLAIEEGGLLLFLVQVESENPIRASFKNGTAAHFHTSGVGKAIMAFMDEAALESFLTPQILVQQTPNSITDVQELKAELCKSRERGWALDDEERFLGMRCIAAPIFDSLGKVVAGVSVSGPITRFPDHKLEDLAKLVVKAATTISDKLTQSSAGS

SEQ ID NO: 736 - protein, 273 aa, Ruegeria atlantica CECT 4292
MDSQKRPRGRPKSLFKESSAGTMQSLDRALGVLTTVARLERAALSDLAREIDVPTATTHRILVTLQKHGFVAFDDERQEWMIGIEAYRTGASFLRRNSVLEIGRPILRRLMQDSGETANLAVPDGSEVVFVGQVETPNPIRAFFPPGARTPMYASGIGKAILAAMSEPGLAKTLGAIAPVEFTANTQIPGDGLQQDLAKTRARGWSHDREERYQGMSCIGSAIFNDRGEPCAGISVSGPTARFGADRAHALGELVLAAAREITHLSGGQTPKT

SEQ ID NO: 737 - protein, 269 aa, Rhizobium sp. N324
MQNLNRRRGRPKSFNEPQSSSVIQSLDRALDVLEALASPEGMTLSELSAHLDQSPATMHRVLATLERREFVEISPDRQVWFIGPEAYRTGAAFLRRSNVVERSRPIMRELMLETGETSNLGIEKDGNILFISQVETHESIRAFFPPGTLSPLHASGIGKALLSTYDDGRLSALFKTSTLKRFTENTARSVAQLKEELIVSRERGYAIDDEERTKGMRCVAAPILNVHGEAVAGISVSGPTHRMPDRLIRQIGERVAGAAKTVSRRLGGG

SEQ ID NO: 738 - protein, 269 aa, Rhizobium sp. N941; identical to SEQ ID NO: 737

SEQ ID NO: 739 - protein, 269 aa, Sinorhizobium americanum CFNEI 73
MQVVKRRRGRPKAFNAPESPNIIQSLDRALDVLEALASPEGLTLSELAAHLGQSAATMHRVLSTLERREFVEISPDRQVWHIGPEAYRLGSAFLRRTNVVERSRPIMRELMLETGETSNLGVEKDGNVLFISQVETHESIRAFFPPGTLSPLHASGIGKALLSTYDDSRLASLFKKTTLERFTANTVRSVAQLEEELRVTRDRGYALDDEERTKGMRCVAAPILNVHGEAVAGISVSGPTHRMPDRQVQQIGERVRNAAKMVSRRLGAP

SEQ ID NO: 740 - protein, 276 aa, Sinorhizobium americanum CFNEI 73
VAVVSEQAKGKRGRKAGANSTPSSVQVLDRSLALFSLVADRDGSTLTDLADETGLAPSTIHRLLTSLSSHGMVAHDPDTGEWTIGVRAFEIGNAFLRFRKLGTISRPYLKRLMDESGETANIGIEDDGDVVFISQVESHAPMRAFFRPGRRGPSHASGIGKAILSTWSDTEIAKTLGGRTLTHFTDRTLDTLPALIRNIQEIRNRGWSIDDEEHTLGMRCIAAPLFNEYGEAIGGISISGPSVRIDDNRLEPLGSLVRRTADELTRAIGGHRPGEG

SEQ ID NO: 741 - protein, 278 aa, Puniceibacterium sediminis DSM 29052
VTGDSEEDFTARGRGRPRSWHDKSEQNTIKSLDRAMEVLERLSEMKGATLSQISGDLGQSPASVYRVLFTLEARGIVDFDSGPQTWHIGAGAFLIGSRFLRRTSLLERALPVLRSLMDATGETANLGIEQSGQVLFLSQVETMATIRAFFPPGTMSPMHASGIGKALLAQRGAGQVARILDAHGLERFTEFTHVTRDALLADLAETRARGYSIDGEEKNIGMRCVAAPIFDVHGVAVAGISVSGPSSRVVPDAIPGLGAQVIAAAAEITHGIGGRVSG

SEQ ID NO: 742 - protein, 269 aa, Hyphomicrobium sulfonivorans WDL6
MLHHGRRRGRPRATKADPAASNIKSLNRALDVLEALAAHEGVTLSGLSSHLHESTATMHRVLSTLERREYVECDPERQEWFIGPAAFKLGSAFLGRTNLVERSRLVMRDLVTISGETSNLGIHRDGQVLFVSQVETQETIRAFLPPGTSAPLHASGIGKALLSSFDDDRLEAFISTAKFTRFTDRTISSANQLRKAIKLTRQCGYALDDEERTIGMRCVAATILDVHGEAVAGISISGPTIRMPDKKVRQIGKWVMEAANEISRRVGAG

SEQ ID NO: 743 - protein, 275 aa, Marivita geojedonensis DSM 29432
MNAETGPERRARGRPRAWGDTTEQNKIKSLDRALVILERLSEWGGATLTDLSEDLKQSPATVYRVLYTFEARGMVDFDPVAQTWHIGAGAFHIGSRFLRRTSLVERARPFLRELMRKTEETANLGISRDGMVLFLSQVETHHNIRAFFPPGTMSPMHSSGIGKALLAQMDDKEVAAIIRKHKLTAFTEHTLVTPEALMSDLEATRKRGYAFDAEEKNDGMRCIAAPVFDMHGEPIAGVSISGPSARIPDERIESLGADVRDTAAKLTAALGGPSD

SEQ ID NO: 744 - protein, 286 aa, Stappia aggregata IAM 12614
MIDPKPDSSATRRARGRPRAWDDKTEQNTIKSLDRAMAVFEHLSTQSGVSLSALSDQLGESTATLYRILFTLETRGLVEFDQAQQLWHIGPGAFIIGARFLRRTSLVERARPILRSLMEQTGETANLGVAQADQVLFVSQVETHESIRAFFPPGTLSPLHASGIGKALLAFMDEDQCKRILKQTDRERFTEHTLCDADLLAADLEAIRARGFSIDGEEKNLGMRCIAAPVFNHYGEAVAGLSVSGPTSRVSPDRIAPFADAVKTAAAALTAALGGENALPQTKTAE

SEQ ID NO: 745 - protein, 271 aa, Sagittula stellata E-37
MSPEKRPRGRPKSAFKESSAGGLQSLDRALMLLSAVARRQSATLSDLARETDIPTATTHRILSTLQAQRYVAFDEERQEWRVGIEAYRTGLSFLARTSVAEVGRPVMRRLMADTGETANLAVPDGAEVVFIGQVETPNPIRAFFPPGTRTSMHASGTGKAILAALRPDRLARVMGRIVFDAYTPGTLASEAALRADLSETARRGWSLDLEERHPGMSCIGAAIRDEQGDPCAGISVSGPTARFSPDRVPGLGRAVREAAREITELSGGRWA

SEQ ID NO: 746 - protein, 275 aa, Roseobacter sp. CCS2
MQDDVKRGRGRPKSWDNKAAQNTIKSLDRALEVLVQLGEMQGSTLSEIAVALDQSPATVYRVLTTFQGRGFADFDEQAQTWSIGPAAFLTGSHFLRRTSLVERARPIMRDLMEATGETANLGIERDGKVLFLGQVETHATIRAFFAPGTASSMHSSGIGKALLCRMDDKRQREVLAASQLEQYTPFTLTDPEAMIADLHATKARGYAIDGEERNIGMRCIAAPVYNVFGEAVAGISVSGPTSRITEDRIEELATPVMDAAARLTRAIGGNNRPAG

SEQ ID NO: 747 - protein, 282 aa, Roseobacter sp. AzwK-3b
MDQTTRRRGRPKGFNSPTSKTTIQSLDRAFDVLDCLAARDGLTLTDIAETLEQSPATIHRVLATLEARGIVDSDTGTQTWFIGAMAYRIGSAFLRRSGVVERARASMRELMQSTGETANLGIEQAGQVMFISQVETPQTIRAFFPPGTVSPMHASGIGKALLAQYADDRMAAFLKAHALTRFTDRTITDPDALREDMALTRARGWAWDDEEKAAGMRCVAAPIFNIFAEPVAGISVSGPTHRMDLARIEEIGAMVREAAAAVSRALGAETNKPSQVADQAAS

SEQ ID NO: 748 - protein, 281 aa, Rhodobacteraceae bacterium KLH11
  MISC_FEATURE (1)..(281): scf_1108856220445 genomic scaffold
MDAQKRPRGRPKSLFKESSAGTMQSLDRALGVLTAVARLERSALSDLAREVEVPTATTHRILVTLQKHGFVIFDEERQEWMIGIEAYRTGASFLHRNNVLEIGRPILRRLMQDSGETANLAVPDGAEVVFVGQVETQNPIRAFFPPGARTPMYASGTGKAILAAMSDESLGKALGATKLIPFTENTCLPGSGLQRDLAKTRARGWSHDHEERYEGMSCIGAAIFNDRGEPCAGISVSGPTVRFCSTRAPELAELVLTAAREITHLSGGRAPELSARHPGNP

SEQ ID NO: 749 - protein, 279 aa, Silicibacter sp. TrichCH4B
  MISC_FEATURE (1)..(279): genomic scaffold scf_1113354613205
MDSQENAPKATRRARGRPRDWHDKTAQNTIKSLDRAMEVFEFLSEAQGKPLTMIAEEMGQSPATVYRILVTLEGRGLVEFDTEEQLWHIGARAFVIGARFLRRTSLVDRARPILRKLMEETGETANLGIEKEGHVLFLSQVETHASIRAFFPPGTLSQMHASGIGKALLAQMESSRLDRLLAATRLEVFTDHTITDHEALKQDLTAIRAQGFAVDNEEKNAGMRCIAAPVFDMNREAIAGISVSGPTSRISVQEITQLSRPVIEAAHALTLAIGGDVTP

SEQ ID NO: 750 - protein, 280 aa, Pelagibaca bermudensis HTCC2601
  MISC_FEATURE: 1100011001308
  MISC_FEATURE (1)..(280): 1100011001308
MDSQDNGSRSPRKARGRPRDWEDKTAQNTIKSLDRAMEVFEFLSERQGMALSTISDEMGQSPSTVYRVLVTLEGRGLVEFDAEEQLWHIGARAFTIGARFLRRTSLVDRARPVMRRLMEATGETANLGVEKEGQVLFLSQVETHANIRAFFPPGTLSAMHASGIGKALLAQMDEDRLSRRLEGGLQSFTPRTITDRIALQEDLARIRARGYSVDDEERNLGMRCIAAPVFDAAGEALAGISVSGPTSRVTADALDRLSRPVIEAARTLTEAIGGQVTRQP

SEQ ID NO: 751 - protein, 276 aa, Paracoccus sp. J39 ICCT; identical to SEQ ID NO: 712

SEQ ID NO: 752 - protein, 276 aa, Paracoccus sp. J55; identical to SEQ ID NO: 712

SEQ ID NO: 753 - protein, 272 aa, Rhodovibrio salinarum DSM 9154
MAQGGRRGRGRPRSASSDTAATTVQALDRGIQVLATLSQFGRATLTDLAVTAEMAPSTVHRLLETLRQHSIVEFDEVDQTWAVGVEAFRIGSTYLLRANYIDAGRQMMRRMVERTGETANLGVPDAGDVVFVSQVETQQPIRAFFPPGTRGHMHASGIGKALLAEMSSERVAAITRQRGLPAFTDNTITTLDRLNEDLAATRTRGWAIDDQERQLGMRCLAAPIFNEFREIVAGISISGPAVRLPDDKLAEFGPLVRESADEVTHRIGGARP

SEQ ID NO: 754 - protein, 287 aa, Rubellimicrobium mesophilum DSM 19309
  MISC_FEATURE: scaffold version
  MISC_FEATURE (1)..(287): scaffold version
MVAAKDLTGNLKNGAERRPRGRPRAFDDKTDQNVIKSLDRSLEVLGELARLEATTLSELARALDEAPATVYRILVTMQAHRMVEFDEAQQVWHVGAGAFLIGSAFLRRTGLIERARPVLRSLMEATGETANLGVESDGAVLFVSQVETHAAIRAFFPPGTKSPLHASGIGKVLLAHAAPDQVRRLLARPLQGYTDRTLTDSGELSAALAEVRARGYAVDNEERTEGMRCVAAGIRNAYGETVAGLSVSGPVSRVRPDAIPALAARVVEAAEAVSLALGARPVSPPAG

SEQ ID NO: 755 - protein, 283 aa, Maritimibacter sp. HL-12
MSDASTTNAPRRARGRPRGWNDKTGQNTIKSLDRAMEVFDHLSTTPGQTLSELAADLRQSPATVYRILITLERRRLVEFERAEQLWHIGPHAFVIGSRFLRRTSLVERARPILRRLMEDTGETANLGIVQGGSVLFVSQVETHANIRAFFPPGSLSPLHSSGIGKALLADMSEERLNRMISHGPLETFTPNTLATKSALVADLAMTRQRGYAIDNEEKNLGMRCIASSVFDMHEEAVAGISISGPSIRMEPDQIARLSRFVVDAAADLTAALGGTPRQEPPSA

SEQ ID NO: 756 - protein, 282 aa, Methylobacterium sp. L2-4; identical to SEQ ID NO: 697

SEQ ID NO: 757 - protein, 269 aa, Ensifer fredii GR64
MQPAKRRRGRPKGFNAPESQTVIQSLDRALDVLEAVAWPEGLTLSELAAHLGQSAATMHRVLATLERREFVEISPDRQVWHIGPEAYRLGSAFLRRTNVVERSRPIMRELMLETGETSNLGIEKDGNVLFISQVETHESIRAFFPPGTLSPLHASGIGKALLSTYDDSRLASLFKKATLERFTENTVRSFAQLEEELRATRDRGYAFDDEERTQGMRCVAAPILNVHGEAVAGISVSGPTHRMSDKRVQQIGERVRSAAKTVSRRLGAP

SEQ ID NO: 758 - protein, 282 aa, Ensifer fredii GR64
VTEYSAVTVVSEQTKGKRGRKAGANSTPSSVQVLDRSLALFSLVADRDGSTLTDLADETGLAPSTIHRLLTSLSSHGMVAHDPDTGEWTIGVRAFEIGNAFLRFRKLGTISRPFLKRLMEESGETANIGIEDDGDVVFISQVESHAPMRAFFRPGRRGPSHASGIGKAILSTWSDTDVAKTLGSKTLTHFTDRTLDTLPALIRNIQEIRNRGWSIDDEEHTLGMRCIAAPLFNEYGEAIGGISISGPSVRIDDDRLETLGSLVRRTADELTRAIGGHRPGES

SEQ ID NO: 759 - protein, 280 aa, Ponticoccus litoralis DSM 18986
MDSQDNGPRGSRKARGRPRDWADKTAQNTIKSLDRAMEVFEFLSERQGMALSTISDEMDQSPSTVYRVLVTLEGRGLVEFDAEEQLWHIGARAFTIGARFLRRTSLVDRARPVMRRLMEATGETANLGVEKEGQVLFLSQVETHANIRAFFPPGTLSAMHASGIGKALLAQMDEGRLMRRLDGGLEAFTPHTVTDRAALLEDLARIRARGYSIDDEERNLGMRCIAAPVFDAAGEALAGISVSGPTSRVTQDELNRLSRPVIEAARTLTEAIGGQVTPRP

SEQ ID NO: 760 - protein, 269 aa, Rhizobium sp. OK494
MPQKPRRRGRPKAFNGPQTQNTIQALDRALDVLDALATPEGKTLSELAGQLGQSAATMHRVLATLERREFVEISPDRQVWHIGPEAYRLGAAFLRRSNVVERSRPIMRELMLETGETSNLGIEKDGNVLFISQVETHESIRAFFPPGTLSPLHASGIGKALLSTYDEDRLSALFRKKEFERFTENTVRSFEQLREELQKTRERGYSFDDEERTKGMRCVAAPILNVHGEAVAGISVSGPIHRLPDADIHQLGERVRSAARMVSRRLGAP

SEQ ID NO: 761 - protein, 274 aa, Planktotalea frisia DSM 23709
MPKSIDSKTPRHRGRPRAFNEKTEQNTIKSLDRALGVLSQLAQIESATLSELASALKESPATLYRVLTTFALHGIVEMDEANQTWHIGPEAYQIGSTFLRRTSLIDVSRPVMRLLMEQTGETANLGIEKSGSVLFVSQVETNAPIRAFFAPGTLSAMHASGIGKALLAHMDEKRLKRFAALGLETFTPHTLSTPETLAADMILTRTRGYALDDQEKNLGMRCIAAPIHNAHGEVVAGVSVSGPTTRVSTDQIETLAAFVMRAAQDISFALGSTR

SEQ ID NO: 762 - protein, 279 aa, Paracoccus denitrificans DSM 415; identical to SEQ ID NO: 10

SEQ ID NO: 763 - protein, 281 aa, Paracoccus halophilus CGMCC 1.6117
MSSEPRKRGRPRGRASGSGDSGGVRALDRALDVLDAIAGASGLTLTEIAQRLALAPSTVHRVLVTLEGRGVAEIDEVTQTWHVGPTAFRHGSAFMRRTGLVERARPVLRRLMEATGETANLGILNGEAVLFLSQAETHETIRAFFPPGTRSPLHASGIGKALLAHKPRREVEMVLDEMVLERFTPMTLCDRQALLDDLGTIRLRGYSLDNEERTPGMRCIAAPIFDPVGEAAAGISVSGPVLRMTDARLPAISEAVLRAARELSFGTAAGGDHPVRESDHA

SEQ ID NO: 764 - protein, 274 aa, Roseovarius tolerans DSM 11457
MTQTKRPRGRPKSQFSESSAGTMQSLDRALGVLTTVARQEGVNLTDLSLSLGIPTATTHRILTTLQKREFVRFDEERQDWTIGIEAYRTGVAYLKRTNLSDAGRPVMRRLMEQTGETANLAVPDGAEVVFIGQVETGNPIRAFFPPGSRTPMHASGIGKALLAALSEERRLALLKGAGLQGFTANTHVTPRALFEDLEQTAARGWSFDRNERYDGMSCIGAAIFNDRGEPCAGVSISGPSSRFSDARLPEFGRAVAQAAAQITHLIAGHDAEGT

SEQ ID NO: 765 - protein, 279 aa, Jannaschia pohangensis DSM 19073
MNTPKPESARLRGRPKAFNDKTDQNTIKALDRAMHVLRSLSELENATLTTLAQTTGDPAASVYRILVTLQAHDIVELDTSDQTWHVGPGAFQIGSVFLRRTSLIERAREPMRDLMEATGETANLGIRSGGDVLFVSQIETHAPIRAFFPPGTRGDLHASGIGKVLLSAMEPERRAAILPSPLPRYTDATLSDPEALAADLTRIAARGYSVDDEEKNTGMRCIAAPVRNLHGEVVAGISVSGPTSRVAPDRVADFARQVIDAAETLSQRLGARPRAPRDD

SEQ ID NO: 766 - protein, 271 aa, Ruegeria sp. 6PALISEP08
VQNHKKPRGRPKSIFKESSAGTLQSLDRALETLTTVAALERCTLSDLSRETGVPTATTHRILTTLSNRGYVSFDEQRQEWMIGIEAYRTGTSYLKRNNVVEIGRPILRKLMRDSGETANMAMPDGKYVVFVNQIETSNPIRAFFPHGARAPMYASGTGKALLAEMTSNALDTFLSDITFEPYTDRTHRSETSLLEDVSLIRQRGWSFDDEERYAGMSCTGAAILNQFGIPCAGVSVSGPTARINKSNAAYFGEMVLEAAREITTAIGGQAR

SEQ ID NO: 767 - protein, 275 aa, Mesorhizobium sp. F7
MEITEKRRRGRPRAFNAPAEPNAVQSLDRALRILAIVADGDGLSLSEVAERSELATSTAYRMLTTLQNRGMVEFAEQEQLWSIGVEAYRIGSAFLRSRRLVDRARSAMQVLMEKTGETANLGVAEDDCVVFVSQVETHQAIRAFFRPGTRSPFHASGIGKAILAYLSPERVEAIVDKTGLEPFTERTLADRDGLHIDLGEIRKRGWSVDDEERYPGMRCVAAPIFNEFGEPIGGVSISGPTVRVTPERLAAIGPEVREAARQITAMIGGEMPKNG

SEQ ID NO: 768 - protein, 280 aa, Oceanicola nitratireducens CGMCC 1.7292
MDSPKSTESTPRRNRGRPRGWDDNSAQYTIKSLDRAMEVLEYLSRRSGLTLSDLAGDLQQSPATVYRILVTLEGRRMVEFDPAEQLWHIGPQAFVIGARFLRRTSLVERARPILRRLMEETGETANLGIVREDAVLFVSQVETHESIRAFFPPGTLSPLHASGIGKALLAEIPNERLEKLLSRRMERFTPHTLASPDALRSDLEVIRTRGYAVDAEEKNLGMRCIAAAVFDASGEAAAGVSVSGPLIRMSEESTDETSRAVMHAARELTAAIGGVIPPAR

SEQ ID NO: 769 - protein, 269 aa, Sinorhizobium fredii CCBAU 25509; identical to SEQ ID NO: 691

SEQ ID NO: 770 - protein, 282 aa, Sinorhizobium fredii CCBAU 25509; identical to SEQ ID NO: 692

SEQ ID NO: 771 - protein, 271 aa, Leisingera sp. ANG-M6; identical to SEQ ID NO: 690

SEQ ID NO: 772 - protein, 271 aa, Leisingera sp. ANG-M7
MSQPPRRKGRPKSFDSASQPTTIQSLDRALDVLDALAGASGMTLTELSSALDQSAATMYRVLSTLEARQIVEMEPQSQTWHIGAMAFRLGSAFLRRSSVIERARPVMRELMEATGETSNLGIERGGDVMFVSQVETHESIRAFFPPGTTSPMHASGIGKALLSCFGEDQLARFLRGRSLERFTEKTLTSADALREDLVQIRSRGWSFDDEEKAQGMRCVAAPVFGMQGEVLAGISISGPTARMPDGGIDGIGALVKDAAQKLSQGMGAPAV

SEQ ID NO: 773 - protein, 275 aa, Loktanella maricola DSM 29128
MTEDVKRGRGRPKAWDNKGAQNTVKSLDRALEVLVQLGEMQGGTLSEIAGALDQSPATIYRVLTTFQGRGFVDFDAQNQTWNIGPAAFLTGSHFLRRTSLVERARPIMRKLMEATGETANLGIERDGKVLFLGQVETHATIRAFFPPGTASSMHSSGIGKALLCRMDNKRQREILAASQLEQYTPFTLTDPDAMIADLHATKARGYAIDAEERNIGMRCIAAPVYNVFGEAVAGISVSGPTSRITEDRIAELATPVMEAAAQLTGAIGGNNRPAG

SEQ ID NO: 774 - protein, 278 aa, Loktanella sediminum DSM 28715
MEHQKEADSGLRRSRGRPRDWHDKTEQNTIKSLDRAMQVFEYLSQEQGKPLSLLAEETGQSPATLYRILVTLEGRGLVEFDAENQIWHIGSQAFVIGARFLRRTSLVERARPILRRLMEATGETANLGVEKGGMVLFLSQVETHENIRAFFPPGTLSPMHSSGIGKALLSQMSDDRFGQWLKDQQLEKFTDRTLANADNLRKDLKGIRQSGYSFDNEEKNVGMQCIAAPVFDMNGEVVAGLSISGPTSRMAMREIDDLGQAVIRSANELSNAIGGQVR

SEQ ID NO: 775 - protein, 282 aa, Tateyamaria sp. ANG-S1
MSGAQNTQENPRRARGRPRGWDDKTEQNTIKSLDRAMEIFEYLSADQGKTLSQLASELSQSPATVYRVLITLEARGLVEFDPEEQRWYVGARAFVIGARFLRRTSLVDRARPILRALMERTGETANLGIEKGGMVLFLNQVETHESIRAFFPPGTLSDMHASGIGKALLAFMDEDRFGQWLKGRSLETFTAHTLVAPDALVQELRRTRARGYAIDAEEKNLGMRCIAAPVFDMYGEAVAGISVSGPATRMGWDVTERISRSVVDAARDLTRAVGGSNRHDAG

SEQ ID NO: 776 - protein, 284 aa, Labrenzia alexandrii CECT 5112
MPERENDLIAGRKARGRPRAWDDKSGQNTIKSLDRAMAVFEHLSTQSGVSLSALSDQTGESTATLYRILFTLETRGLVEFDQAQQLWHIGPAAFIVGARFLRRTSLVERARPILRELMEETGETANLGIQKGDQVLFVSQVETHASIRAFFPPGSLSPLHASGIGKALLAFMPETQCEKILKSAKRERFTSYTLCDAGLLKADLAQAQTRGYSIDGEEKNLGMRCIAAPVFNHYGEIAAGLSISGPTSRLTEDKIQSLGSAVMNAAGTLTSALGGEPPIETSDQ

SEQ ID NO: 777 - protein, 282 aa, Roseovarius litoreus DSM 28249
MDQTTRRRGRPKGFNSPTSKTTIQSLDRAFDVLDCLAARDGLTLTDIAETLEQSPATIHRVLATLEARGIVDSDTGTQTWFIGAMAYRIGSAFLRRAGVVERARASMRELMQSTGETANLGIEQAGQVMFISQVETPQTIRAFFPPGTVSPMHASGIGKALLAQYSDDRMAAFLKAHALTRFTDRTITDPDALRQDMDLTRARGWAFDDEEKAAGMRCVAAPIFNIFAEPVAGISVSGPTHRMDLARIEEIGTMVREAAAAVSRALGAETGKPSQAADQAAS

SEQ ID NO: 778 - protein, 304 aa, Labrenzia sp. CP4
MLYFSYGELIFQNQKNELMTDLKSDSSATRRARGRPRAWDDKTEQNTIKSLDRAMAVFEHLSTQSGVSLSALSDQLGESTATLYRILFTLETRGLVEFDQAQQLWHIGPGAFIIGARFLRRTSLVERARPVLRSLMEQTGETANLGVAQADQVLFVSQVETHESIRAFFPPGTLSPLHASGIGKALLAFMDEDQCKRILKQTDRERFTEHTLCDAGLLAADLEAIRARGFSIDGEEKNLGMRCIAAPVFNHYGEAVAGLSVSGPTSRVSPDRIAPFAEAVKAAAAALTAALGGEIAPPQTKTVE

SEQ ID NO: 779 - protein, 269 aa, Rhizobium sp. N541; identical to SEQ ID NO: 737

SEQ ID NO: 780 - protein, 279 aa, Paracoccus sp. MKU1
MSVQIRKRGRPRGRAGGFGAEDSGGIRALDRALDILDLIAASSGLTLTEIAQRLEMAPSTVHRVLVTLAARGVAESDSQTQAWHVGPTAFRHGSAFMRRSGLVERARPLLRRLMEVTGETANLGILNGDAVLFLSQAETHETIRAFFPPGTRSALHASGIGKALLAHARPADLKRMIREMRLERFTEMTLTDPQALLEDLARIRVRGYALDNEERTPGMRCIAAPIFDLGGEAAAGISVSGPTLRMSDARLAAMSEAVIEAARELSFGMAPRPGEGESA

SEQ ID NO: 781 - protein, 282 aa, Pseudoruegeria marinistellae SF-16
MESRENDQRPHRKARGRPRNWVDKTAQNTIKSLDRAMEVFEFLSEAQGMTLTAISDEMGQSPATVYRILVTLQGRGLVGFDAEEQLWHIGPQAFVIGARFLRRTSLVDRARPILRKLMEATGETANLGTEKEGAVLFLSQVETNASIRAFFPPGTLSPMHASGIGKALLAEMDSERLERTLGRAELTIFTDRTITERAALLEDLKQIRSRGFSIDDEEKNTGMRCIAAPVFDMNREAIAGISVSGPTSRVDGGQIERLSRPVMEAAQELTIAIGGPATRPPS

SEQ ID NO: 782 - protein, 273 aa, Ruegeria conchae DSM 29317
MESQKRPRGRPKSMFKESSAGTMQSLDRALGVLTTVAGLERVALSDLAREVDVPTATTHRILVTLQKHGFVSFDEERQEWMVGIEAYRTGASFLRRNNVLEIGRPILRRLMLDSGETANLAVPDGPEVVFVGQVETQNPIRAFFPPGARTPMYASGTGKAILAALSEESLNKVLARTDLIAFTENTNLPQAGLHDDLAETRRRGWSYDHEERYEGMSCIGAAIFNDRAEPCAGISVSGPTVRFSLDRAPELGMLVRNAAQEITHLSGGRSPSQ

SEQ ID NO: 783 - protein, 286 aa, Labrenzia sp. C1B10
MTDLKSDSSATRRARGRPRAWDDKTEQNTIKSLDRAMAVFEHLSTQSGVSLSALSDQLGESTATLYRILFTLETRGLVEFDQAQQLWHIGPGAFIIGARFLRRTSLVERARPVLRSLMEQTGETANLGVAQADQVLFVSQVETHESIRAFFPPGTLSPLHASGIGKALLAFMDEDQCKRILKQTDRERFTEHTLCDAGLLAADLEAIRARGFSIDGEEKNLGMRCIAAPVFNHHGEAVAGLSVSGPTSRVSPDRIAPFAEAVKAAAAALTAALGGEIAPPQTKTVG

SEQ ID NO: 784 - protein, 282 aa, Methylobacterium radiotolerans NDB3P7; identical to SEQ ID NO: 704

SEQ ID NO: 785 - protein, 280 aa, Roseovarius sp. 217
MTQTKRARGRPKSQFADSSAGTMQALDRALSVLTAVARQEGVNLTDLSLSLGIPTATTHRILTTLQKRDFVRFDEERQDWTIGIEAYRTGVAYLKRTNLADAGRPVMRRLMEQTGETANLAVPDGAEVVFIGQVETQNPIRAFFPPGSRTPMHASGTGKAILASLPEDRLMALLKGAGLKGFTEETLITPRALFDDLAETRRRGWSFDRNERYDGMSCIGAAIFNDRGEPCAGVSISGPSSRFGDAQIAEFGAAVAQAATQITHLIAGKGVVISETNGSR

SEQ ID NO: 786 - protein, 259 aa, Roseovarius sp. 217
MSDPQSQGVQSVARALRLLQLLSQQDEGARVSDLARLAGLAVSTTHRLLTTLELQHFAQFDSDRALWHVGRGAFSVGAAFSRRHNFVAPALPLLRRLRDATRETANLGILDQDELVTLSQVESREIMRAISPPGGRVPAFCSGMGKAILATWPNADIADFVARTGFHPMTKRSHRSLSTAMVDIKRIRAQGYALDDEEHVTGLRCLAAVVWSPQAEAVCAISVSGLAARLPDARLSAIGRQVAEAAADLTLKIGGQRPV

SEQ ID NO: 787 - protein, 269 aa, Rhizobium leguminosarum bv. trifolii WSM597
MTVPVRRRGRPKGFNDPQTQNVVQSLDRALDVLEALASPEGMTLSELAKHLAQSAATMHRVLATLERRDYVEMSPDGQIFHIGPEAYRLGAAFLRRTNVIERSRPVMRELMLETGETSNLGIEKNGKVLFVSQVETHESIRAFFPPGTLSPLHASGIGKALLSTYDEERLAALFKGATLQRFTANTLRTIEQLREELEITRQRGYAFDDEEKAAGMRCVAAPVLNVHGEAVAGISVSGPAHRMPDRQIKRIGQRVIEAARLVSNRLGAS

SEQ ID NO: 788 - protein, 277 aa, Artificial Sequence
  synthetic peptide
  MISC_FEATURE (1)..(277): pMeth_A285
MPQPPRRKGRPKGFDSASQPTTIQALDRALDVLDALAGASGMTLTELSTGLGQSAATMYRVLATLEARQIVEIEPQSQTWHIGAMAFRLGSAFLRRSSVIERARPVMRELMEATGETSNLGIERNGDVMFVSQVETHESIRAFFPPGTISPMHASGIGKALLSCFGEDQLARFLRGRTLERFTAKTLISAKALRADLLQIRSRGWSFDDEEKAPGMRCVAAPVFGMQGEVLAGISISGPASRMPDAGINGIGALVKDAAEKLSYGLGAPAAVETQPG

SEQ ID NO: 789 - protein, 288 aa, Roseobacter litoralis Och 149
MNTQKRQRGRPKSQFKESSAGTMQSLDRALGVLVAVAKSEQSTLTDLSLSLGVPTATTHRILTTLQKHRFVIFNEEHQSWSIGIEAYRTGASFMNRTSLTEVSRPIMRFLMEKTGETANLAIPDGAEVVFVEQIETPHPIRAFFARGARTSMHASGIGKAILSTMSEDHVRRLLMSSGLQAFTDNTLTSPATLFADLAETKTRGYSYDREERYLGMSCIGSAVFDERGEACGGVSISGPSTRFDSMRVPELGAIVAEAAGQISQLIGGRRREPHADDIAPNPTADPAG

SEQ ID NO: 790 - protein, 288 aa, Octadecabacter antarcticus 307
MPDDPDTAPFHAQSRARGRPKAWVDKTEQNTIKSLDRALEVLSRLGDLEEATLSELASDLGQSPATIYRVLTTYRTHAFTDFDESRQVWSVGAGAFLTGAKFLRRTSMVERARPHLRRLMEATEETANLGVAKDADVLFLSQSETHHAIRAFFPPGTLSPMHASGIGKALLAQWPQKRVDAMLAARTPEQFTAFTLVTRDALMGDLRETQRRGYSFDGEEKNIGMRCIAAPVFDVYGDAVAGLSISGPVARITDEKIAEIGALVRAGADALTRELGGVSPHHPTRFEA

SEQ ID NO: 791 - protein, 274 aa, Methylopila sp. M107
MTRELERRRRGRPKGFHESSVGPIRSIERAFDVLEVLASSDGVTLSELSERLGQSVTTMHRVLSTLERRRYAEHVIDCQEWHVGSQAFRLGSSFLRRNDVVEQSRPDMRELMLATGETSNLGIERQGDVLFVSQIETHESIRAFFPPGTLSPLHASGIGKALLSAFDAQRLARFLHTTELTCFTETTITSRDKLVDEVRQIQGRGYALDNEERSLGMRCVAACVTDMYDEVVAGISVSGPVSRLPLAAIPEIGMLVKQAAQRISEKMGASQFDK

SEQ ID NO: 792 - protein, 293 aa, Loktanella sp. SE62
MFFSYDEFVFHMRWKMARDITKTRGRPKAWDDKTAQNTLKSLDRALEVLIALGEMEGGTLSELAKALNQSPATVYRVLTTFRQRGFVDFDEQNQTWYIGPTAFLTGSRFLRRTSLVERARPVMRELMEATGETANLGIERDGKVLFLGQVETHATIRAFFPPGTVSAMHASGIGKALLAWMDDARQRRVLAAGRLERFTPHTLTEPEPMIADLHASRARGYAIDGEERNLGMRCIAAPVFNLYGEAVAGISVSGPTARMSEDRVPELAASVMSAAGRLSAAIGGSGNSRALAP

SEQ ID NO: 793 - protein, 271 aa, Phaeobacter gallaeciensis ANG1; identical to SEQ ID NO: 690

SEQ ID NO: 794 - protein, 281 aa, Rhodobaca barguzinensis DSM 19920
MAEPRTRGRPRAFHDKSEQNTVQSLDRALGILRVLSESSGLTLTELAQAADQSPATVYRVLSTFQAHGMVELEAEGQRWHVGAGAFRVGSAFLRRTKLAERARGAMQTLMRETGETANLGVEEKDEVLFLTQVETHEAIRAFFPPGTRSPMHVSGIGKALLAYYPITRVARIMAQGLPGFTAASLTDGIALENDLIDTRARGYAIDNEERTEGMRCIAAPIFNAHGEPVAGLSISGPVFRLSLERAKDMGELVRTAAAGVTEATGGRVPQKGAAGSLARPG

SEQ ID NO: 795 - protein, 273 aa, Mameliella alba DSM 26384
MNSPKRPRGRPKSAFKESSAGTLQALDRALGVLTALARDEGTTLSDLSREIDIPTATTHRILTTLENHRFVTFDEERQEWAVGIEAWRTGTAFLKRNSVVEVGRPVMRRLMKETGETANLAVPDGLEVVFVGQVETPNPIRAFFPPGTRTAMHASGIGKAILAAMRPQAQQRLIEDMDLTPFTASTHVTLSGLTADLHSIAARGWSHDREERHAGMSCIGAAILNDQGEPCAGISVSGPTVRFSGEGIADLGRRVAEAAQEITDLSGGAMRDV

SEQ ID NO: 796 - protein, 279 aa, Paracoccus denitrificans DSM 15418
MSVQIRKRGRPRGRAGGLGAEDSGGIRALDRALDILDLIAVSSGLTLTEIAQRLDMAPSTVHRVLVTLAARGVAESDSQTQAWHVGPTAFRHGSAFMRRSGLVERARPLLRRLMEVTGETANLGILNGDAVLFLSQAETHETIRAFFPPGTRSALHASGIGKALLAHARPLDLKRMLREMRLERFTDMTLTDPAALVEDLVQIRARGYALDNEERTPGMRCIAAPIFDLAGEAAAGISVSGPTLRMSDARLSAMSDAVIEAARELSFGMAPREDAGERA

SEQ ID NO: 797 - protein, 276 aa, Ruegeria halocynthiae MOLA R1/13b
MENQKRPRGRPKSLFKESSAGTMQSLDRALGVLTTVARLERAALSDLAREVGVPTATTHRILVTLQKHGFVAFDEERQEWMTGIEAYRTGASFLRRNSVLEIGRPILRRLMQDSGETANLAVPDGAEVVFVGQVETLNPIRAFFPPGARTPMYASGTGKAILAAMSDDGLARTLAIANPVPFTGNTLVQEKTLRSDLSETRARGWSHDREERYEGMSCIGAAIFNERAEPCAGISVSGPTVRFDAARAPELGARVVEAAQEITRLSGGRNPNVPGD

SEQ ID NO: 798 - protein, 286 aa, Roseivivax isoporae LMG 25204
VATGDDTPESGRRARGRPRGWHDRTEQNTIKSLDRAMEVLDRLSELPGVSLSALAADLDQSPATVYRVLTTLEGRGLVEFDAEAQLWHVGAQAFVIGARFLRRTSLVERARPILRNLMEATGETANLGVARGPAVLFVSQVETDASIRAFFPPGTLSPMHASGIGKALLARMDERRLARLLSTPLERFTEHTFCDADALRTELAATRARGWALDGEEKTLGMRCIAAPVFDMSGEAVAGVSVSGPVSRVSDGSIDRVAQEVCAAAAALTAAVGGVWPAPAGAGGRG

SEQ ID NO: 799 - protein, 280 aa, Citreicella thiooxidans DSM 10146
MDSPKDAEISPRRARGRPRGWEDNSAQNTIKSLDRAMEVLEYLSSRPGLTLSELAGDLDQSPATVYRILVTLEGRRLVEFDPTEQLWHIGPQAFVIGARFLRRTSLVERARPILRGLMEETGETANLGIVREASVLFVSQVETHESIRAFFPPGTLSPLHASGIGKALLAEMPGERLEKLRARPMERFTPHTLASPEALLNDLAAIRERGYSIDAEERNLGMRCIAAAVFDASGEAVAGISVSGPTIRMGEESTHEASRAVMRAARELTAAIGGVRPPVR

SEQ ID NO: 800 - protein, 282 aa, Antarctobacter heliothermus DSM 11445
MDSQGNRDEPRRKARGRPRGWEDKTAQNTIKSLDRAMAVFEYLSEAQGKPLTLLADEMGQSPATVYRILVTLEGRGLVEFDPEEQVWHIGPRTFVIGARFLRRTSLVDRARPIMRKLMEATGETANLGIEKEGAVLFLSQVETHANIRAFFPPGTLSAMHASGIGKALLAQMDDDRLDRHLATSELTAFTDCTLADPEALKADLRTIRAQGYSVDNEEKNTGMRCIAAPVFDMNQEAVAGISVSGPTSRVSVAQIEQLSRPVMEAARDLTFAIGGAVAEPPT

SEQ ID NO: 801 - protein, 274 aa, Nitratireductor sp. ZZ-1
MAPQVGRARGRPRSFHNTAQNSLIQSLDRAMDVLKVVAGGSGLSLTEIADRSGQSASTAYRILITLEKHRVVQFDEPAQLWHVGLEAFRIGSSFLGRTSIVEQSRPVMQRIMAETGETANLAIIDRGEVIFVSQVETHEPIRAFFRPGTRGPVHASGIGKALLAFLPEIQAQTILKQGAQDAYTDKTIVSGEALAAEMATIRTRGWAIDDEERTPGMRCIAAPIFNQFGEAVAGVSLSGPAFRITPKRDADYGVLVRKAADEITRAIGGMPPRG

SEQ ID NO: 802 - protein, 269 aa, Rhizobium sp. CNPSO 671
MQNLNRRRGRPKSFNEPQSSSVIQSLDRALDVLEALASPEGMTLSELSAHLDQSPATMHRVLATLERREFVEISPDRQVWFIGPEAYRTGAAFLRRSNVVERSRPIMRELMLETGETSNLGIEKDGNILFISQVETHESIRAFFPPGTLSPLHASGIGKALLSTYDDGRLSALFKTSTLKRFTENTARSVAQLKEELIVSRERGYAIDDEERTKGMRCVAAPILNVHGEAVAGISVSGPTHRMPDRLIKQIGERVAGAAKTVSRRLGGG

SEQ ID NO: 803 - protein, 266 aa, Pseudomonas stutzeri NP_8HO
MADPTRKRGRPRKTLPDAPGTVQSLDRALDLLDLLAAHPGLTLSEVADRSAQPPSTVHRVLHTLAARGMAESDPATQAWNIGPQAFRLGSAFMRRSGLVERARPIMRALMEHTGETANLGILQGDSVLFLSQVETSETIRAFFPPGTRSPLHASGIGKALLAFRPDSVAALGPLARFTDTTLTDPAALEADLARIRHRGFSFDDEERSRGMRCIAAPVFDLSGEAIAGISVSGPTHRIGAEHVKTLGAVVAAAAANLSDALGGPTR

SEQ ID NO: 804 - protein, 251 aa, Pseudomonas stutzeri NP_8HO
MADPTRRRGRPCADGPDRPLTVQALDRALDMLDLLSLHPGLTLSEVAQRTGLPASATHRILQTLALRGMVERCAATQCWSVGPSSFRLGAAFLRRSGLIARARPILQDLVARTQETANLGILSDGGVLFVSQVESDQPIRVAFPPGTRASLTGSGIGRAMLAINAGPAPDTACPDLARIRRQGFAFDDQGRMAGMRCVAAPIVDMAGRAVAGLSINAPAHRIRTRQVGAIGAAVAEAAARLTAVTGEQLHL

SEQ ID NO: 805 - protein, 273 aa, Pseudomonas stutzeri NP_8HO
MQQPVRKRGRPKGGKADQPAASIQALDRGLDVLEALAAHEGITLTGLSTHLDQSPATMHRVLATLEHRRYVENNPDRQEWFIGPEAFRLGSAFLRRTNIVERSRAVMRDLMALTGETANLGIERDGDVLFVSQVETHQTIRAFFPPGTRSPLHASGIGKALLAAFDQTRLAMFLRDATFTRFTDKTIADADALQADIALIRHRGFAFDDEERTLGMRCVAASIVNSYGEAVAGVSVSGPTNRMTDAAVDRIGGMVATAAERISADLGSGRGGR

SEQ ID NO: 806 - protein, 273 aa, Ruegeria sp. ANG-R
METQKRPRGRPKSLFKESSAGTMQSLDRALGVLTTVARSERSSLSDLAREVGVPTATTHRILVTLQKHGFVTFDEERQEWMVGIEAYRTGASFLRRNSVLEIGRPILRRLMQDSGETANLAVPDGAEVVFVGQVETQNPIRAFFPPGARTPMYASGTGKAILAALSEEGLKKVLGATDLTAFTENTYLPGPGLYEDLTETRARGWSFDREERYEGMSCIGAAIFNDRAEPCAGISVSGPTVRFSSEHAPELGELVLNAAQEITYLSGGRLPKG

SEQ ID NO: 807 - protein, 273 aa, Mameliella alba CGMCC 1.7290; identical to SEQ ID NO: 795

SEQ ID NO: 808 - protein, 269 aa, Pseudorhodobacter antarcticus CGMCC 1.10836
MADEQRSRGRPKRFDGDESQNIIQSLDRAIDVLETLAQGGAMTLSQVASTMDQSPATIYRVLSTFRVRGMAEVNPASQEWSVGAEAFRIGSAFLRRSNVIARAMPIMQQLRDETGETSNLGIERDDNVVFIAQVETHESIRAFFPPGTQAPMHASGIGKALLAMFPEKHLARYLAQAHLPPFTANTICTPDGLRAHLVQIRTQGYSFDDEEKAIGMRCIAAPIVNFHGDAVAGVSISGPSHRLPCDGVARIGALVKAAGDKISASLGAL

SEQ ID NO: 809 - protein, 279 aa, Loktanella sp. DSM 29012
MDSQDNLSSTGRRARGRPRDWDDKTSQNTIKSLDRAMEVFEFLSEAQGKALTTIATEMGQAPATVYRVLVTLEGRGLVEFDAVEQIWHIGPTAFVIGSRFLRRTSLVDRARPVLRKLMENTGETANLGAERDGSVLFLSQVETHSNIRAFFPPGSLSPMHASGIGKALLAEMDAGHLERTIDGAPLTAFTLHTITDKDALLADLETTRDRGYALDGEEKNLGMRCIAATVFDVNAEPVAGISVSGPTSRVGANDIPRLSLAVIDAARELTAAIGGIRPR

SEQ ID NO: 810 - protein, 279 aa, Paracoccus thiocyanatus ATCC 700171
MSVQIRKRGRPRGRAGGPNAEDSGGIRALDRALDILDLIAVSSGLTLTEIAQRLGMAPSTVHRVLVTLAARGVAESDSQTQAWHVGPTAFRHGSAFMRRSGLVERARPLLRRLMEQTGETANLGILNGDAVLFLSQAETHETIRAFFPPGTRSALHASGIGKALLAHAPPADLKRMIAGMALERFTPTTLTDPQALVQDLVRIRARGYALDNEERTPGMRCIAAPIFDLGGEAAAGISVSGPSLRMSDARLASMSQAVIEAARALSFGMAPDPAPRDGT

SEQ ID NO: 811 - protein, 275 aa, Rhodovulum sulfidophilum TUT; identical to SEQ ID NO: 728

SEQ ID NO: 812 - protein, 269 aa, Roseovarius sediminilitoris DSM 29439
METPKRRMGRPKNFNSNEKQTTILALDRALDVVDALAHANGMTLSQLSAHLDQSPATMHRVLATLHARNFVEMDERAQTWHIGSAAFRMGSAFLRRSSIVERSRPIMRELMEATGETSNLGIERNGVVMFISQVETQESIRAFFPPGTLSPMHASGIGKALLSCYSETRTNQYLRMAELTRFTEKTIILPDMLKNELTVIREKGWAFDDEEKAEGMRCIAAPIRDIYGEAVAGVSISGPTHRIPKSEVERIGALVSDAAAQVSRGLGSS

SEQ ID NO: 813 - protein, 277 aa, Leisingera sp. ANG-M1
MPQPPRRKGRPKSFDSASQPATIQSLDRALDVLDALAGANGMTLTELSASLDQSAATMYRVLSTLEARQIVEIEPQSQTWHIGAMAFRLGSAFLRRSSVIERARPVMRELMEATGETSNLGIERGGDVMFVSQVETHESIRAFFPPGTTSPMHASGIGKALLSCFEEDQLTRFLRGRTLEQFTAKTLTSPDALRADLAQIRSRGWSFDDEEKAPGMRCVAAPVFGMQGEVLAGISISGPTARMPDGGISGIGALVKDAAQKLSYGLGAPAADETPPG

SEQ ID NO: 814 - protein, 270 aa, Roseovarius azorensis DSM 100674
MTQPKRPRGRPKSQFSESSAGTMQALDRALGVLTAVAREEGVNLSDLSLSLGIPTATTHRILTTLQQRDFVRFDEERQDWTIGIEAYRTGVAYLKRTNLADAGRPVMRRLMEQTGETANLAVPDGAEVVFIGQVETQNPIRAFFPPGSRTPMHASGTGKAILAALPEERLLALLKGAGLKGFTDKTHVTPRALFDDLAQTRARGWSFDRNERYDGMSCIGAAIFNDRGEPCAGVSISGPSSRFADMQIAEFGRAVAQAAAQITHLVAGRS

SEQ ID NO: 815 - protein, 275 aa, Sulfitobacter pseudonitzschiae DSM 26824
MVSQDNPPSEPRRARGRPRDWSDKTAQNTIKSLDRAMEVFEFLSEHQGKALTTLATETDQSPATVYRILVTLEGRGLVEFDAVEQLWHIGPRAFVIGARFLRRTSLVERARPVMRRLMEQTGETANLGIERGGQVLFVSQVETEATIRAFFPPGTLSPMHASGIGKALLAEMDDARLQRALAGKTLTAFTPHSITDLNALRADLAQVRARGYAVDAEERNIGMRCIAAPVFDIHQEAVAGISVSGPTSRVGLEDIERLSVAVRAAAADLSATLGG

SEQ ID NO: 816 - protein, 275 aa, Ruegeria sp. CECT 5091
METQKRPRGRPKSLFKESSAGTMQSLDRALVVLTAVARMERAALSDLAREVDVPTATTHRILATLQKHGFAAFDDERQEWMIGIEAYRTGASFLRRNSVIEIGRPILRRLMQDSGETANLAVPDGAEVVFVGQVEAQNPIRAFFPPGARTPMYASGTGKAILAAMSESAASKVLAAEAVRFTSHTLLPGEGLREDLANTRSRGWSHDHEERYEGMSCIGAAIYNDRGEPCAGISVSGPSVRFIADRAMELGALVRDAAEEITQLSGGRLPKPSEE

SEQ ID NO: 817 - protein, 282 aa, Pseudoruegeria haliotis DSM 29328
MKSPNNGGRAIRKSRGRPRDFHDKTPQNTIKSLDRAMEVFEYLSTTQGRALSELAAEMDQAPATIYRILITLEGRKLVEFDPTSQVWYIGPRAFVIGARFLRRTSLVDRARPVLRQLMEDTGETANLGIEQNGRVLFVSQVETHASIRAFFPPGTLSRLHASGIGKALLAQMAPDRIERFLNAAPLERFTEFTLTGRDELLEDLEATRQRGFALDGEERNLGMRCIAAPIFDVHNEAVAGISVSGPTSRVSPEQIPALSAAVLTAAKNLTDAIGGSAILPPA

SEQ ID NO: 818 - protein, 264 aa, Pararhodobacter aggregans DSM 18938
MTESRRGRPKAFHDKTEQNTIRALDRAMALLQALAGSDGMTLTELAQAEGESPATTYRVLTTLAQRQMVELDPRGQVWYVGAGTFRTGAAFLRRTNVVERARAPMQALMRATNETANLGIEQQGEVLFLTQVETHQAIRAFFSPGTRSALHASGIGKALMAWMPGLNPGPLTRFTEATITEPEALARNLALTRSRGWALDNQERTEGMRCVAAPIFNAHGEPVAGVSISGPVFRLPPDALPELGARVRAAAAEITRSIGGAVKS

SEQ ID NO: 819 - protein, 279 aa, Rhodovulum kholense DSM 19783
MTQPRLRGRPRAFHDKTEQNTVRALDRAMGLLSALSETKGLTLSELATLTGQSPATVYRVLITLQGHDIVELEDEAQRWHVGPGAFRIGSGFLRRTNVAERSRGAMQTLMRATGETANLGVEDRDEVLFLTQVETHEAIRAFFPPGTRGPMHTSGIGKALLAHLPPARVAAILKSKGLPGFTPLSITDEAALGEDLARTRARGYAIDDQERAEGMRCIAAPIFNAHGEPVAGLSVSGPAFRIPLEAAARIGTEVRAAADRVTAAIGGTVGLAGAAEKSA

SEQ ID NO: 820 - protein, 269 aa, Rhizobium yanglingense LMG 19592
MTVPIRRRGRPKGFNDPQTQNVVQSLDRALDVLEALASPEGMTLSELAKHLDQSAATMHRVLATLERRDYVEMSPDGQIFHIGPEAYRLGAAFLRRTNVIERSRPVMRELMLETGETSNLGIEKNGKVLFVSQVETHESIRAFFPPGTLSPLHASGIGKALLSTYDEERLAFLFKGATLQRFTANTLRTIDQLKEELEITRQRGYAFDDEEKAAGMRCVAAPVLNIHGEAVAGISVSGPAHRISDRQVKRIGQRVIEAARLVSNRLGAS

SEQ ID NO: 821 - protein, 286 aa, Labrenzia sp. C1B70; identical to SEQ ID NO: 783

SEQ ID NO: 822 - protein, 272 aa, Starkeya novella DSM 506
  MISC_FEATURE (1)..(272): chromosome
MTQAVPIVRRRGRPSSTGGAEPGGEVQSLDRAIALLEVLARSDGLSLSELARSAELPTSTVHRLLTTLERRGLVGHDAATGSWMVGVGLFRVGSAYLRIRKLPEIARALLRELSHGVNETVNLSLIDGPHLICVAQVESHAAVRAFFRIGGDLPIHASGGGKAILATMNPEARRAWLGDDQLQRFTEHTHVSRRALQADLAEIAARGYSIDDEEHTPGMRCVAAAVLDEWREPVGAISISAPTVRMPPERIADLGAQVREAAARLTLRYSGR

SEQ ID NO: 823 - protein, 279 aa, Ruegeria mobilis 45A6
MDSQENAPKATRRARGRPRDWHDKTAQNTIKSLDRAMEVFEFLSEAQGKPLTMIAEEMGQSPATVYRILVTLEGRGLVEFDTEEQLWHIGARAFVIGARFLRRTSLVDRARPILRKLMEETGETANLGIEKEGHVLFLSQVETHASIRAFFPPGTLSQMHASGIGKALLAQMDVGRLDRLLATTRLEVFTDHTITDHEALKQDLTAIRAQGFAVDNEEKNAGMRCIAAPVFDMNREAIAGISVSGPTSRISAQEITQLSRPVIEAARALTLAIGGDVAP

SEQ ID NO: 824 - protein, 278 aa, Oceaniovalibus guishaninsula JLT2003
MDSPNNGAPEPTGRRPRGRPRAFDEKTEQNTIKALDRAMDILRALSRMDGATLTALAQETGDVPATVYRVLVTLQAHGIVEADEAAQTWHVGPGAFLIGSAFLRRTSLVERSRPALRRLMEQSGETANLGIASDDRVLFVSQVETHAPIRAFFPPGTRSAMHASGIGKVLMAAMDAPRLERIVAAGLTRYTPRTLTEPNALLADLEAIRKRGYAIDDEERNLGMRCIAAPIRNAHQEVIAGLSVSGPISRMTPDKTEALAVRVMTAAASVSAGMGARD

SEQ ID NO: 825 - protein, 289 aa, Loktanella vestfoldensis DSM 16212
MQLRFSYGENIFQKVSHLQHEARKTRGRPKAWDDKAAQNTVKSLDRALEVLVALGEMQGGTLSEIASALRQSPATVYRVLTTFQGRGFVDFDRQAQVWSIGAAAFLTGSQFLRRTSLVERARPIMRDLMEATGETANLGIERDGKVLFLGQVETHATIRAFFPPGTVSAMHASGIGKALLAHMDDARQRRVLAASKLEQFTPLTLTDPEAMIADLHATRMRGYAFDGEERNLGMRCIAVPIHDVSGEAVAGLSVSGPTTRIADDKIAELAQAVMAAAARLTAAIGGTPR

SEQ ID NO: 826 - protein, 269 aa, Rhizobium etli bv. mimosae Mim1
MTVPVRRRGRPKGFNDPQTQNVVQSLDRALDVLEALASPEGMTLSELAKHLGQSAATMHRVLTTLERRDYVEMSPDGQIFHIGPEAYRLGAAFLRRTNVIERSRPVMRELMLETGETSNLGIEKNGKVLFVSQVETHESIRAFFPPGTLSPLHASGIGKALLSTYDEERLGVLFKGATLQRFTANTLRTIDQLKEELEVTRQRGYAFDDEEKAAGMRCVAAPILNVHGEAVAGISVSGPAHRMPDRQIKRIGQRVIEAARLVSNRLGAS

SEQ ID NO: 827 - protein, 271 aa, Methylobacterium komagatae DSM 19563
MDSGNRRRGRPKGFGGAKPTETIQALDRALDVLDVLAESDGLTLSELAGKLGQSVATMHRVLATLERRAFVEISADKQEWHVGAEAYRLGSAFLRRHNVVERSRPMMWTLMQETGETSNLGVEKEGSVLFVSQVETHETIRAFFPPGSLSPLHASGIGKALLATYEPDRTERLFRGKTFARFTDKTIGSLEQLREDIEATRHRGYAIDDEERTIGMRCVAAPILNFHGEAIAGISVSGPTHRLSDEKLKEIGERVRKGAATVSRLLGATTA

SEQ ID NO: 828 - protein, 269 aa, Rhizobium tropici YR635
MPQEPRRRGRPKAFNGPQTQNTIQALDRALDVLDALATPEGKTLSELAGQLGQSAATMHRVLATLERREFVEISPDRQVWHIGPEAYRLGAAFLRRSNVVERSRPIMRELMLETGETSNLGIEKDGNVLFISQVETHESIRAFFPPGTLSPLHASGIGKALLSTYDEDRLSALFRKKEFERFTENTVRSFEQLREELQKTRERGYSFDDEERTKGMRCVAAPILNVHGEAVAGISVSGPIHRLPDADIHQIGERVRSAARMVSRRLGAP

SEQ ID NO: 829 - protein, 269 aa, Aurantimonas altamirensis DSM 21988
MAGEIRRRGRPKAFNEPEGEARVKAVDRALDVLDAIAASDGISLSRLADQLDESVATIHRVLGTLEHRDFVECGADDQLWRVGSGAFRLGSSFLRRTNVVEQSRPALRQLMQLCGETANLGMEKEGFVLFLSQVETHEAIRAFFPPGTLSPLHASGIGKALLSTYDAPRFETFCATVPMVRFTDKTLTSAQDLARDIALARQRGFAVDDEEKSPGMRCVAAPIRNHHGEAVAGISVSGPTHRMGTERLDEIGAHVKAAATEVSRRLGAA

SEQ ID NO: 830 - protein, 275 aa, Sulfitobacter sp. MCCC 1A00686; identical to SEQ ID NO: 815

SEQ ID NO: 831 - protein, 286 aa, Methylobacterium sp. 13MFTsu3.1M2
MDSGNRRRGRPKGFGGAKPAATIQALDRALDVLDVLAGGDGLTLSELAGRLEQSVATMHRVLATLERRGLVEISADKQEWHVGAEAYRLGSAFLRRHNVVERSRSMMWTLMQETGETSNLGVEKDGNVLFVSQVETHETIRAFFPPGSLSPLHASGIGKALLSTYAPARTERLFRGKTFARFTDKTIGSLDQLRDDVEATRRRGYAIDDEERSIGMRCVAAPILNVHGEAIAGISVSGPTHRLSDEKLRAIGERVRRGAAAVSRALGAPAATMTATPDAPGAPDRD

SEQ ID NO: 832 - protein, 286 aa, Methylobacterium sp. 275MFSha3.1
MDSGNRRRGRPKGFGGAKPAATIQALDRALDVLDVLAGGDGLTLSELAGRLEQSVATMHRVLATLERRGLVEISADKQEWHVGAEAYRLGSAFLRRHNVVERSRSMMWTLMQETGETSNLGVEKEGNVLFVSQVETHETIRAFFPPGSLSPLHASGIGKALLSTYAPARTERLFRGKTFARFTDKTIGSLDQLRDDVEATRRRGYAIDDEERSIGMRCVAAPILNVHGEAIAGISVSGPTHRLSDEKLRAIGERVRRGAAAVSRALGAPAATMTATPDAPGEPDQD

SEQ ID NO: 833 - protein, 279 aa, Paracoccus pantotrophus DSM 11073; identical to SEQ ID NO: 711

SEQ ID NO: 834 - protein, 284 aa, Marinovum algicola DSM 10251
MVLMDSQDNGGKRGPRRARGRPRGWEDKTAQNTIKSLDRAMEVFEYLSAAQGRSLTALASETRQAPATVYRILVTLEGRGLVEFDAEDQTWHIGPRAYVIGARFLRRTSLVDRARPYLRRLMEDTGETANLGIEQEGAVLFLSQVETHASIRAFFPPGTLSPMHSSGIGKVLLAQMDDARLGRFLAATRLEVFTDHTITDREALRADLRKVRARGFSIDNEEKNAGMRCIAAPVFDLNGEAIAGISVSGPTSRVSMAEVDRLSRPVIAAARDLTHAIGGIMREV

SEQ ID NO: 835 - protein, 279 aa, Paracoccus versutus DSM 582
MSVQIRKRGRPRGRAGGLGAEDSGGIRALDRALDILDLIAVSSGLTLTEIAQRLEMAPSTVHRVLVTLAARGVAESDSQTQAWHVGPTAFRHGSAFMRRSGLVERARPLLRRLMEVTGETANLGILNGDAVLFLSQAETHETIRAFFPPGTRSALHASGIGKALLAHARPADLKRMIREMRLERFTEMTLTDPQALLDDLARIRARGYALDNEERTPGMRCIAAPIFDLAGEAAAGISVSGPSLRMSDARLEAMSEAVIEAARELSLGMAPHAGAGEER

SEQ ID NO: 836 - protein, 281 aa, Thalassobius aestuarii DSM 15283
MDSQENGPNEGRRARGRPRDWHDKTEQNTIKSLDRAMAVLEYLSRSKGLPLTRIAEDMGQSPATVYRVLVTLEGRGLVDFDADEQVWNIGPGAFVIGARFLRRTSLVDRARPIMRKLMEDTGETANLGIEKEGSVLFLSQVETHETIRAFFPPGTLSDMHSSGIGKALMAHMETDRLQRVLAKSSLQAFTEYTITDRDALMQDLAQIRARGFSIDNEERTAGMRCIAAPVFDMNGEALAGISVSGPTSRVSPEEIARLGAPVTEAAKALTQAIGGVAPALT

SEQ ID NO: 837 - protein, 281 aa, Litoreibacter janthinus DSM 26921
MSDFFDEAQTHRNRGRPRAWDDKTSQNTIKSLDRAMGVLDYLSTLQGATLSELASDLGESAATVYRILVTLQSRELVEFDADGQLWHVGPRAFLIGTRYLRRTSLVDRARPILRRLMEITGETANLGIARNAHVLFVSQVESHASIRAFFPPGTLSPMHASGIGKALLAEMPADRLSRVLAAAPLERFTDKTHTDAGALRADLTEIHARGYSVDDEEKNLGMRCIAAAVFDWHGEAVAGISVSGPLSRMSIEQTRELAKAVTTAAADLSAALGAETRVKPA

SEQ ID NO: 838 - protein, 251 aa, Paracoccus sp. 361
MADPTRRRGRPCADGPDRPLTVQALDRALDMLDLLSLHPGLTLSEVAQRTGLPASATHRILQTLALRGMVERCAATQCWSVGPSSFRLGAAFLRRSGLIARARPILQDLVARTQETANLGILSDGGVLFVSQVESDQPIRVAFPPGTRASLTGSGIGRAMLAINAGPAPDTACPDLARIRRQGFAFDDQGRMAGMRCVAAPIVDMAGRAVAGLSINAPAHRIGTRQVGAIGAAVAEAAARLTAVTGEQLHL

SEQ ID NO: 839 - protein, 273 aa, Paracoccus sp. 361
MQQPVRKRGRPRSGKADQPAASIQALDRGLDVLEALAAHEGITLTGLSTHLDQSPATMHRVLATLEHRRYVENNPDRQEWFIGPEAFRLGSVFLRRTNIVERSRAVMRDLMALTGETANLGIERDGDVLFVSQVETHQTIRAFFPPGTRSPLHASGIGKALLAAFDQTRLAVFLRDATFTRFTDKTIADADALQADIALIRHRGFAFDDEERTLGMRCVAASIVNSYGEAVAGVSVSGPTNRMTDAAVDRIGGMVATAAERISADLGSGRGGR

SEQ ID NO: 840 - protein, 266 aa, Paracoccus sp. 361
MADPTRKRGRPRKTLPDAPGTVQSLDRALDLLDLLAAHPGLTLSEVADRSAQPPSTVHRVLHTLAARGMAESDPATQAWNIGPQAFRLGSAFMRRSGLVERARPIMRALMEHTGETANLGILQGDSVLFLSQVETSETIRAFFPPGTRSPLHASGIGKALLAFRPDSVAALGPLARFTDTTLTDPAALEADLARIRHRGFSFDDEERSRGMRCIAAPVFDLSGEAIAGISVSGPTHRIGAEHVKTLGAVVAAAAASLSDALGGPTR

SEQ ID NO: 841 - protein, 281 aa, Paracoccus homiensis DSM 17862
METQENHPSRERRARGRPRGWDDKTAQNTIKSLDRAMQVFEYLSEDQGTTLTRLADGMGQSPATVYRILVTLEGRGLVEFDPDEQVWHIGPRAFVIGARFLRRTSLVERARPIMRKLMEVTGETANLGVEKEGLVLFLSQVETHASIRAFFPPGTLSALHASGIGKALLAHMDRDRLDRLLSARDLQAFTHSTITRQDALRDSLSEIRALGYAVDHEERNEGMRCIAAPVFDINQEVVAGISVSGPTTRVNPAAVQRLSQPVIEAARDLTLAIGGRPLAVT

SEQ ID NO: 842 - protein, 266 aa, Paracoccus homiensis DSM 17862
MPQPSRRRGRPRSGADSAGTIQSLERALDILDMLAGHSGLTLSEVADKMQQSPSTVHRVLHTLASRGVVESDPATQSWQIGPAAFRLGSAFMRRSGIVERARPVLRALMEHSGETANLGILNGECVLFISQAETQETIRAFFPPGTRSPLHASGIGKALLAFGRPQTLDQTLAQAPLQRFTDKTLTQPQELRDDVARIRARGFAFDDEERTRGMRCIAAPVFDLTGEAVAGISVSGPTHRIGSEHVKTLGAVVAAAAADLTQKMGG

SEQ ID NO: 843 - protein, 273 aa, Ponticoccus sp. UMTAT08
MNSPKRPRGRPKSAFKESSAGTLQALDRALGVLTALARDEGTTLSDLSREIDIPTATTHRILTTLENHRFVTFDEERQEWAVGIEAWRTGTAFLKRNSVVEVGRPVMRRLMKETGETANLAVPDGREVVFVGQVETPNPIRAFFPPGTRTAMHASGIGKAILAAMRPQAQQRLIEDMDLTPFTASTHVTLSGLTADLHSIAARGWSHDREERHAGMSCIGAAILNDQGEPCAGISVSGPTVRFSGEGIADLGRRVAEAAQEITDLSGGAMRDV

SEQ ID NO: 844 - protein, 286 aa, Methylobacterium sp. Leaf361; identical to SEQ ID NO: 721

SEQ ID NO: 845 - protein, 278 aa, Aestuariivita boseongensis BS-B2
MAEEPPQIAESRRARGRPRDWHDKTAQNTIKSLDRALEVLETLSDMGGATLSELAAEADQSPATVYRVLITLEGRGMVEFNPTEQLWNIGARAFLIGSRFLRRTNLVERARPILRQLMEATGETANLGMERAGQVLFLSQVETHASIRAFFPPGTLSPMHSSGIGKALMAQLSDARLDGIIAEHGLDQFTPHTLTDPDMLKADLAATRDRGYSIDAEERNEGMRCVAAPVFDAYGDVVAGISVSGPSSRIVDHMIAGFGEQVSQAAADLSRAIGADRP

SEQ ID NO: 846 - protein, 281 aa, Paracoccus isoporae DSM 22220
MAIPDNPESGPRRTRGRPRGWDDKTAQNTIKSLDRAMAVFDHVSRGSGLALSTIAAETQESPATIYRILVTLAGRGLVEFDAEAQLWHIGPHAFTIGTRFLRRTSLVDRARPVLRRLMEATGETANLGVEREGAILFVSQVETHASIRAFFPPGTLSPMHVSGIGKALLAAMPQDRLERLLAGQDFASFTEHTITDRDRLADELRRIRARGYAVDDEERNLGMRCIAAPVFDMNAEAVAGVSLSGPTSRVTPDAVVGLSGEVIAAAEALTRAIGGVARREV

SEQ ID NO: 847 - protein, 270 aa, Aminobacter aminovorans KCTC 2477
MIEQAGKRRGRPKGSKSSSPATSIQALDRGIDVLEALAAHDGITLTELSAHLGQSSATMYRVLATLEQRRYVETSPERQEWFVGPEAFRLGSAFVRRTNIVERSRSIMRELMSKTGETSNLGIEREGHVLFVSQVESHETIRAYFPPGARSPLHASGIGKALLSAFDEERLEAFIKATNFTRFTDKTIATAGRLREEMHATRQRGYSFDDEERTIGMRCVAACILNGYSEAVAGISISGPTPRMPDARIREMGLLVTEAAHEISRRLGAS

SEQ ID NO: 848 - protein, 278 aa, Aminobacter aminovorans KCTC 2477
MATMEKRQRGRPRAFQPASDAGSVQSLDRALRILAIVAHGDGLSLSEISAASDLAAATAYRMLTTLQNHGMVEFDSDGQLWSIGVETYRMGAAFLRRRKLVDRARAVMQELMEKTGETANLGVAEDDCVVFVSQVETHQAIRAFFRPGTRSPFHASGIGKAVLAHLDRERVNAIVRKAGLDAYTERTLSEPALLARDLEKIRSRGWSVDDEERYPGMRCIAAAVFNEFGEPIGGVSVSGPTVRVTSERLGEIGPIVRDAAAELTRMIGGSPEGTVPGL

SEQ ID NO: 849 - protein, 275 aa, Loktanella litorea DSM 29433
MDQDVKRGRGRPRAWDDKGDQNTIKSLDRALEVLVKLGELQGATLSELASALDQSPATVYRVLTTFQGRGFVDFDEIGQTWNIGPAAFMTGSHFLRRTSLVERARPIMRHLMEATGETANLGIERGGKVLFLGQVETHATIRAFFPPGTEGAMHSSGIGKALLSRMDDARQRQVLAASKLEKFTPHTLTDPETMIADLRETRARGYAFDGEERNIGMRCIAAPVFNVYGEAVAGISVSGPTSRITDDRIQVLAEEVIDAAERLTRATGGNYRPAG

SEQ ID NO: 850 - protein, 279 aa, Rubrimonas cliftonensis DSM 15345
MNMTVKRPRGRPRGADADRGGAVQSLERALGLLTALARQDSATLSDLALRTGTPPSTAHRLLTTMEASRYVAFDEATNLWTIGVEAFRTGSSFLRQTRVVDAARDVMRELVELTGETANVAVPDGGEVVFVSQVETSHPIRAFFGPGARAHMHASGIGKALLAAMGRAEVERRLQKVGLPEFTPNTLASPAALFADLERIRGRGWSLDDEERNLGMRCVAAAIRNAHGEAVAGVSISGPCVRLPHDRVAEVGPMVRRAAARITERIGGAQPDESAAAAS

SEQ ID NO: 851 - protein, 274 aa, Planktotalea frisia SH6-1; identical to SEQ ID NO: 761
  MISC_FEATURE (1)..(274): PFRI

SEQ ID NO: 852 - protein, 268 aa, Aureimonas altamirensis ON-56566
VGEIRRRGRPKAFNEPEGDARVKAVDRALDVLDAIAASDGISLSRLADALGESVATVHRVLGTLEHRDFVECGTDDQLWRVGSGAFRLGSSFLRRTNVVEQSRPALHQLMQLCGETANLGMEKEGFVLFLSQVETHEAIRAFFPPGTLSPLHASGIGKALLSTYDAPRFRSFCEKAPMLGFTAQTLTSAEDLARDIALTRQRGFAVDDEEKSPGMRCVAAPIRNHHGEAVAGISVSGPTHRMGTERLEEIGAHVKNAATQVSRRLGAT

SEQ ID NO: 853 - protein, 275 aa, Ruegeria sp. ZGT108
MENRKRPRGRPKSLFKESSAGTMQSLDRALNVLTTLARMERAVLSDLAREVDVPTATTHRILATLQKHSFAAFDDDRQEWMIGVEAYRSGASFLRRNSVIEVGRPILRRLMEESGETANLAVPDGAEVVFVGQVETPNPIRAFFPPGARTPMYASGTGKAILSAMSDTASSKVMSADAERFTSFTLLPGEGLRADLAETRARGWSHDHQERYEGMSCIGAAIFNDRGEPCAGVSVSGPSVRFSQDRAAGLGALVMRAAQEITELSGGRLPERSKR

SEQ ID NO: 854 - protein, 266 aa, Paracoccus sediminis DSM 26170
MSEPTRRRGRPRSAKDQGGTVQVLDRALDMLDLLAAHPGLTLSEVADRMDQSPSTVHRLLHSLAARGMVESDPATQAWNIGPATFRLGSAFMRRSGIVERARPILRALMEHTGETANLGILNGDAVLFVSQAETHETIRAFFPPGTRSPLHASGIGKALLAFGRPEVLRGYLDGPGLKRFTDKTQVTVDALAQDMARIRARGFSFDDEERTRGMRCIAAPVFDMSGEAIAGVSVSGPSHRIGHEHVKTLGAVVAAAAAELSAAMGG

SEQ ID NO: 855 - protein, 286 aa, Ruegeria scottomollicae DSM 25328
MDSQETGPKTTRRARGRPRDWHDKTAQNTIKSLDRAMEVFEFLSEAQGKPLTSIAEDMGQSPATVYRILVTLEGRGLVEFDTEEQLWHIGAQAFVIGARFLRRTSLVDRARPILRRLMEVTGETANLGIEKEGHVLFVSQVETHASIRAFFPPGSLSQMHASGIGKALLAQMEASRLDRLLAATRLEVFTDHTITDGDALKQDLAAIRTQGFAVDNEEKNAGMRCIAAPVFDMNREAVAGISVSGPTSRISEQEIAELSRPVIEAAEQLTQAIGGVAPVAHKGGDP

SEQ ID NO: 856 - protein, 269 aa, Rhizobium leguminosarum CGMCC 1.2553T
MTVPVRRRGRPKGFNDPQTQNVVQSLDRALDVLEALASPEGMTLSELAKHLDQSAATMHRVLATLERRDYVEMSPDGQIFHIGPEAYRLGAAFLRRTNVIERSRPVMRELMLETGETSNLGIEQNGKVLFVSQVETHESIRAFFPPGTLSPLHASGIGKALLSTYDEERLSVLFKGAALQRFTANTLRTINQLKDELEITRQRGYAFDDEEKAVGMRCVAAPVLNIHGEAVAGISVSGPAHRISDRQVKRIGQRVIEAARLVSNRLGAS

SEQ ID NO: 857 - protein, 282 aa, Sulfitobacter sp. HI0021
MESQDNGSGTGRKARGRPRGWTDKTAQNTIKSLDRAMEVFEYLSEAQGKPLSKLADEMRQSPATVYRILVTLEGRGLVEFDHEEQVWYIGPRAFVIGARFLRRTSLVDRARPIMRKLMETTGETANIGVGKEEAVLFLSQVETHANIRAFFPPGSLSPMHASGIGKALLAYMDPERLDKLLSKGQMTRFTAHTIIDPTALRQNLEAIRESGFSVDNEERNEGMRCIAAPVFDMNGEAVAGISISGPTSRVGASEVEELSRPVIKAAHQLSFAIGGSVTRPQP

SEQ ID NO: 858 - protein, 282 aa, Sulfitobacter sp. HI0076; identical to SEQ ID NO: 857

SEQ ID NO: 859 - protein, 261 aa, Thalassobius mediterraneus CECT 5118; identical to SEQ ID NO: 700

SEQ ID NO: 860 - protein, 278 aa, Thalassobius mediterraneus CECT 5118; identical to SEQ ID NO: 699

SEQ ID NO: 861 - protein, 273 aa, Rhodobacteriaceae sp. PT6CLA
  MISC_FEATURE: uncultured Rhodobacteriaceae sp. PT6CLA
  MISC_FEATURE (1)..(273): uncultured Rhodobacteriaceae sp. PT6CLA
MVEIQRKPRGRPKSPFTDGSGGTIQALDRALAILSALAQQDHASLTDLSEDLAIPTATTHRILATLQQNGYAELDESTQTWAVGVEAYRTGSAYLNRTNLADVSRPAMRALMQDTGETANLAVPDGAAVVFVGQIETQNPIRAFFAAGTRTPMHASGTGKAILAHLPATRQARLLSQIDLTVFTDQTLATLAELQADLASTQARGWSFDQEERHLGMSCIGAPIYDARGEVVAGVSISGPSTRFSDRRVDAFGTRVAQAAAEITDGIGGRLPG

SEQ ID NO: 862 - protein, 269 aa, Sinorhizobium terangae WSM1721
MQVVKRRRGRPKAFNAPESPSVIQSLDRALDVLEALASPEGLTLSELAAHLGQSVATMHRVLSTLERREFVEISPDRQVWHIGPEAYRLGSAFLRRTNVVERSRPIMRELMLETGETSNLGIEKDGHVLFISQVETHESIRAFFPPGTLSPLHASGIGKALLSTYDDSRLTSLFKKRTLERFTENTVRSIAQLEEELRVTRDRGYAFDDEERTKGMRCVAAPILNVHGEAVAGISVSGPTHRMPDRQVQKIGERVRNAATKVSRRLGAP

SEQ ID NO: 863 - protein, 273 aa, Sinorhizobium terangae WSM1721
MEASGKGRRGRKAGENAAPSSVQVLDRSLTLFSLVADRDGSTLTDLADQTGLAPSTIHRLLTSLASHGMVAHDPDTGEWTIGVRAFEIGNAFLRFRKLGTISRPFLKRLMDESGETANIGIEDDGDVVFISQIESHAPMRAFFRPGRRGPIHASGIGKAILSTWSDTEIAKGLSGRTLTRFTRRTLDTLPALIKNVQEIRNRGWSVDDEEHTLGMRCIAAPLFNEYGEAIGGISISGPTVRIDDDKLEVLGPVVRLTADELTRAIGGHRPGEG

SEQ ID NO: 864 - protein, 273 aa, Ruegeria sp. TW15; identical to SEQ ID NO: 782

SEQ ID NO: 865 - protein, 276 aa, Rhizobium sp. BR816
MAIVSEQTKGKRGRKAGANATPSSVQVLDRSLALFSLVADRDGSTLTDLADETGLAPSTIHRLLTSLSSHGMVAHDPDTGEWTIGVRAFEIGNAFLRFRKLGTISRPYLKRLMDESGETANIGIEDDGDVVFISQVESHAPMRAFFRPGRRGPSHASGIGKAILSTWSDTEIAKTLGGRTLTHFTDRTLDTLPALIRDIQEIRNRGWSIDDEEHTLGMRCIAAPLFNEYGEAIGGISISGPSVRIDDKKLDPLGSLVRRTADELTRAIGGHRPGEG

SEQ ID NO: 866 - protein, 269 aa, Rhizobium sp. BR816
MQPAKRRRGRPKGFNAPESPSVIQSLDRALDVLEALASPEGLTLSELAAHLSQSAATMHRVLSTLERREFVEISPDRQVWHIGPEAYRLGSAFLRRTNVVERSRPIMRELMLETGETSNLGIEKDGNVLFISQVETHESIRAFFPPGTLSPLHASGIGKALLSTYDDSRLASLFKKTTLERFTANTVRSIVQLEEELRVTKDRGYALDDEERTKGMRCVAAPILNVHGEAVAGISVSGPTHRMPDRQVQQIGERVRNAAKMVSRRLGAP

SEQ ID NO: 867 - protein, 279 aa, Paracoccus pantotrophus J40; identical to SEQ ID NO: 711

SEQ ID NO: 868 - protein, 284 aa, Marinovum algicola DG 898
MVLMDSQDNGGKRGPRRARGRPRGWEDKTAQNTIKSLDRAMEVFEYLSAAQGRSLTALASETRQAPATVYRILVTLEGRGLVEFDAEDQTWHIGPRAYVIGARFLRRTSLVDRARPYLRRLMEDTGETANLGIEQDGAVLFLSQVETHASIRAFFPPGTLSPMHSSGIGKALLAQMDDARLGRFLAATRLEVFTDHTITDREALRADLREVRARGFSIDNEEKNAGMRCIAAPVFDLNGEAIAGISVSGPTSRVSMAEVDRLSRPVIAAARDLTHAIGGMMREV

SEQ ID NO: 869 - protein, 284 aa, Labrenzia alexandrii DFL-11
MPERENDLIAGRKARGRPRAWDDKSGQNTIKSLDRAMAVFEHLSTQSGVSLSALSDQTGESTATLYRILFTLETRGLVEFDQAQQLWHIGPSAFIVGARFLRRTSLVERARPILRELMEKTGETANLGIQKGDQVLFVSQVETHASIRAFFPPGSLSPLHASGIGKALLAFMPETLCEKILKSSKRERFTSYTLCDAGLLKADLAQAQTRGYSIDGEEKNLGMRCIAAPVFNHYGEIAAGLSISGPTSRVTENKIQSLGSAVMNAAGTLTSALGGEPPIETSDQ

SEQ ID NO: 870 - protein, 163 aa, Methylobacterium sp. 285MFTsu5.1
MRDLMMATGETSNLGIERNGEVLFVSQVESHETIRAFFPPGASSPLHASGIGKALLSGFDEERFESFVRRTHLTSFTDKTIVNADRLREAVRQIRRQGYSFDDEERTTGMRCVAAFISNGYGEAVAGISISGPTPRLPDDRIREIGARVVEAAREVSRRLGAE

SEQ ID NO: 871 - protein, 286 aa, Methylobacterium sp. 285MFTsu5.1; identical to SEQ ID NO: 721

SEQ ID NO: 872 - protein, 282 aa, Methylobacterium sp. EUR3 AL-11; identical to SEQ ID NO: 704

SEQ ID NO: 873 - protein, 280 aa, Paracoccus yeei ATCC BAA-599
MTELRKKGRPRGRAGDSGDSGGIRALDRALDILDAIAAGNGLTLTEIGQRLQMAPSTVHRVLVTLAARGVAEQDASSQAWHVGPTAFRHGSAFMRRSGLVERARPVLRRLMETTGETANLGILNGDAVLFLSQAETHETIRAFFPPGTRSPLHASGIGKALLAHARPQELRAMIRGLRLERFTPHTLSEPEQLAEDLVRIRARGYSLDNEERTLGMRCIAAPIFDLAGEAAAGISVSGPVHRMSDDRLAEITGAVVAAGRELSLGLGPGQGSGRGTEAKP

SEQ ID NO: 874 - protein, 282 aa, Defluviimonas sp. 20V17; identical to SEQ ID NO: 693

SEQ ID NO: 875 - protein, 276 aa, Sphingomonas sp. DC-6
MQQPVRRRGRPKSAKADAQAPGIQSLDRALDVLEALAQHEGITLTELAVHLDQSPATMHRVLATLEQRKYVESNPDKQEWFIGSETFRLGSAFLRRTNIVERSRPVMRDLMARTGETSNLGIERDGDVLFVSQIETHETIRAFFPPGTRSPLHASGIGKALLSAFSDERLEIFLGSGKFTRFTDKTIANAKQLREAIEETRRRGYSFDDEERTIGMRCVAASIINGYGEAVAGISVSGPTIRMPDKRVREIGQLVSEAADEISRQLGSPAHAENPA

SEQ ID NO: 876 - protein, 280 aa, Rhodobacteraceae bacterium bin18
  MISC_FEATURE: Alphaproteobacteria (AP)
  MISC_FEATURE (1)..(280): Alphaproteobacteria (AP)
MPDDFPTESTGRAVRGRGRPKAWDDRSAQNTIKSLDRAMAVFEHLSTTTGATLSELAADTDQSPATTYRILVTLEARGLVEFDAGPQLWHIGPRAFLIGARYLHRTSLVERARPVLRRLMERTGETANLGIARDGHVLFISQVETHASIRAFFPPGTLSPMHASGIGKALLAQMTPEARARALAEAGLERFTARTLTDPAQIEADMVLTQARGYAIDDEEKTEGMRCIAAPVTDLHGEVVAGISVSGPASRVSDAEIPRLAAAVTEAAATLSAALGAPAA

SEQ ID NO: 877 - protein, 269 aa, Paracoccus sulfuroxidans CGMCC 1.5364
MREVRKRGRPKNVGTPDEAGGVKALERALDVLDLLAASNGLTLTEIAKALGTAPSTIHRVLTTLDARGVAESDPITQAWHIGPSAFRHGTAFMRRSSIVERARPIMRRLMEATGETANLGILNGDAVLFLSQVETHETIRAFFPPGTRSPFHASGIGKALLAHAKPDVLRQILDDAVLSRFTDKTLTERDALLADLEVTRTRGYSFDDEERTLGMRCIAAPVYDLAGEAVAGISVSGPMHRMTEDRCGKIAEAVMVAAQDLSLGIPSRS

SEQ ID NO: 878 - protein, 280 aa, Yangia pacifica DSM 26894
MDSPKDAETSPRRARGRPRGWEDNSAQNTIKSLDRAMAVLDYLSAHPGLTLSELAGDLKQSPATVYRILVTLEGRRLVEFDSAEQLWHIGPQAFVIGARFLRRTSLVERARPVLRGLMEETGETANLGIVREASVLFVSQVETHESIRAFFPPGTLSPLHASGIGKALLAEMAGERLEKLLARKMERFTAHTLAEPEALRADLSAIRARGYSIDAEEKTLGMRCIAAAVFDASGEAVAGISVSGPTIRMREDMTDTTSRAVMRAAQELTAAIGGVTPPVR

SEQ ID NO: 879 - protein, 279 aa, Shimia haliotis DSM 28453
MDFPKNEPASPRKTRGRPRGWDDKTAQNTIKSLDRAMQVFEYLSEEQGKALSQLAEEMGQAPATVYRVLVTLEGRGLVEFDRYEQVWHIGPRAFVIGARFLRRTSLVDRARPIMRRLMEETGETANLGVEREGAVLFLSQVETHASIRAFFPPGTLSQMHASGIGKALLAHMDAGRLDRVFSSDVPKKFTEFTITDLSDLQTDLAGIRDRGYSVDNEEKNLGMRCIAAPVFDQNREAVAGISVSGPTSRVSPEEVERLSRPVVDAAHALTAAIGGEVVA

SEQ ID NO: 880 - protein, 261 aa, Hasllibacter halocynthiae DSM 29318
MSNARGRPRGWQEGERVKSLDRALGVLAALAGRPGLGLSELGRQLGQAPATLHRILGTLAAHGMAEMDADQGWHVGPAAFRIGSAFLRRTSLVERAQPVLRALMRETGETANLGVVRDGHVLFLAQAETHAAIRAFFPPGTLSPLHASGIGKAVLAALPPERRLAALGDTLDGFTPHTLTAPDALGADLATAAARGWAIDAEERHEGMRCIACAVRDPSGAPVAGLSVSGPAARMLSAGEERIGRAVVARAQELSASLGTG

SEQ ID NO: 881 - protein, 280 aa, Oceanicola nitratireducens DSM 29619; identical to SEQ ID NO: 768

SEQ ID NO: 882 - protein, 273 aa, Ruegeria halocynthiae DSM 27839
MESQKRPRGRPKSLFKESSAGTMQALDRALGVLTTVAQLERVVLSDLAREVDIPTATTHRILVTLQKHGFVSFDEERQEWMVGIEAYRTGASFLRRNNILEIGRPILRRLMLDSGETANLAVPDGPEVVFVGQVETQNPIRAFFPPGARTPMYASGTGKAILAALSEDSLNKVLGQTDLIAFTENTNLPHAGLQEDLAETRARGWSYDHEERYEGMSCIGAAIFNDRGEPCAGISVSGPTVRFDRERAPELGALVRNAAQEITHLSGGRSPGG

SEQ ID NO: 883 - protein, 280 aa, Citreimonas salinaria DSM 26880
MATAEDGTGQRRARGRPRAWSDTTEQNRIKSLDRAIGVLERLSELGGATLSDLAEATDHAPASLYRILVTLESRGMVDFDPVPQTWHIGPSAFRIGSRFLRRTSLVERARPVLRTLMEATGETANLGIAREGHVLFVSQVETHESIRAFFPPGTMSPMHASGIGKALLAQLPPERAAHIAAKHGLTRFTGRTLTAPEALAADLAQTRRRGYAIDDQEKTRGMRCIAAPIFDMHDEAVAGLSISGPADRLPDDAIPDIGAKVIEAAASVSRGLGAGRVASV

SEQ ID NO: 884 - protein, 279 aa, Ruegeria mobilis S1942
MDSQENAPKATRRARGRPRDWHDKTAQNTIKSLDRAMEVFEFLSEAQGKPLTMIAEEMGQSPATVYRILVTLEGRGLVEFDTEEQLWHIGARAFVIGARFLRRTSLVDRARPILRKLMEETGETANLGIEKEGHVLFLSQVETHASIRAFFPPGTLSQMHTSGIGKALLAQMESSRLDRLLATTRLEAFTDHTITDHEALKQDLATIRAQGFAVDNEEKNAGMRCIAAPVFDMNREAIAGISVSGPTSRISAQEISQLSRPVIEAARALTLAIGGDVTP

SEQ ID NO: 885 - protein, 277 aa, Leisingera aquaemixtae CECT 8399
MPQAPRRKGRPKNFDSASNPPTIQSLDRALDVLDALAGASGMTLTELSTALDQSAATMYRVLATLEARQIVEMEPQSQTWHIGAMAFRLGSAFLRRSSVIERARPVMRELMEATGETSNLGIERGGDVMFVSQVETYESIRAFFPPGTTSPMHASGIGKALLSCFGEDQLARFLRGSALQDFTEKTLTSADALREDLAQIRRRGWSFDDEEKAPGMRCVAAPVFGMQGEVLAGISVSGPTSRMPDARISEIGALVRGAAEKLSYGLGAPAADQAAPG

SEQ ID NO: 886 - protein, 277 aa, Leisingera aquaemixtae CECT 8399; identical to SEQ ID NO: 885

SEQ ID NO: 887 - protein, 281 aa, Paracoccus halophilus JCM 14014; identical to SEQ ID NO: 763

SEQ ID NO: 888 - protein, 246 aa, Ruegeria sp. ZGT118
MEVFEHLSEAQGKTLSTISAETGQAPATVYRILVTLEGRGLVEFDHKEQIWHIGPQAFVIGSRFLRRTSLVDRARPILRKLMEVTGETANLGVEKEGAVLFLSQVETHASIRAFFPPGTLSPMHASGIGKALLAYMDTERLDRVLASAELQAFTERSITAPDALRADLARIRARGYSVDNEEKNAGMRCIAAPVFDATREAVAGISVSGPTSRVSESEIDRLSRPVIEAAQRLTQAIGGTFNDPRT

SEQ ID NO: 889 - protein, 280 aa, Ruegeria faecimaris DSM 28009
METQKRPRGRPKSLFKESSAGTMQSLDRALSVLTTVASLERAALSDLAREVDVPTATTHRILVTLQKHGFVAFDEERQEWMIGIETYRTGASFLRRNGVIEIGRPILRRLMQDSGETANLAVPDGAEVVFVGQVETANPIRAFFPPGARTPMYASGTGKAILAALNEAALIKALGTLDTKVFTPQTLVHGDGLQSDLNQTRARGWSHDREERYEGMSCIGAAIFNDRGEPCAGISVSGPTARFSTERAPELGRLVQAAAQEVTLLSGGRLPARDAGDAGL

SEQ ID NO: 890 - protein, 280 aa, Shimia sagamensis DSM 29734
MVSQRNDKNDGPKARGRPRDWHDKTAQNTIKSLDRAMEVFEFLSEEQGKTLSQIADEMGQSPATVYRILVTLETRGLVEFEGREQLWHIGPRAFIIGARFLRRTSLVDRARPVMRKLMELTGETANLGVEREGQVLFLSQVETHASIRAFFPPGTLSQMHASGIGKALLAHMEAGRRNRLLASEQLTEFTERTITDVDALLEDLLVIRERGYSVDDEERNMGMRCIAAPVFDFNGEAVAGISVSGPTSRVSPEETEKLARAVVSAAKELTLAIGGEIAAS

SEQ ID NO: 891 - protein, 282 aa, Sulfitobacter sp. HI0027; identical to SEQ ID NO: 857

SEQ ID NO: 892 - protein, 277 aa, Rhodobacterales bacterium Y4I
  MISC_FEATURE (1)..(277): scf_1106129324775 genomic scaffold
MPQAPRRKGRPKNFDSASNPPTIQSLDRALDVLDALAGASGMTLTELSTALDQSAATMYRVLATLEARQIVEMEPQSQTWHIGAMAFRLGSAFLRRSSVIERARPVMRELMEATGETSNLGIERGGDVMFVSQVETYESIRAFFPPGTTSPMHASGIGKALLSCFGEDQLTRFLRGRTLKEFTEKTLTSAEALREDLAQIRRRGWSFDDEEKAPGMRCVAAPVFGMQGEVLAGISVSGPTSRMPDTRISEIGALVRGAAEKLSYGLGAPAADQAAPG

SEQ ID NO: 893 - protein, 272 aa, Artificial Sequence
  synthetic peptide
  MISC_FEATURE (1)..(272): cNanh_4411
MKPTARRKGRPKAFDSKPTQTTIQSLDRALEVLDTLALENGMTLTEVSDRLKQSPATMYRVLSTLQARGFVEIDAAAQTWHIGAMAFRLGSAFLRRSGVVDRSRPVMRDLMEATGETSNLGIERDGEVMFIGQVETTETIRAFFPPGTLSPMHASGIGKALLSQRDADSLGRFLRTYPLNRFTDKTIGTAPALQAELTAIRQQGYAFDDEERTAGMRCVAAPILNLYGEAIAGISVSGPTHRMPADRIREIGRLVQQAANTVSRGLGAPEDT

SEQ ID NO: 894 - protein, 279 aa, Methylobacterium mesophilicum SR1.6/6
MDSGSRRRGRPKGFGGAKPSATIQALDRALDVLDVLADGDGLTLSELAGTLGQSVATMHRVLATLERRGLVEISADKQEWHVGADAYRLGSAFLRRHNVVERSRSMMWTLMQETGETSNLGVEKDGNVLFVSQVETHETIRAFFPPGSLSPLHASGIGKALLSTYAPARTERLFRGKTFARFTDKTIASLDQLRDDVEATRRRGYAIDDEERTIGMRCVAAPILNFHGEAIAGISVSGPTHRLSDAQLQAIGERVRKGAAAVSRALGAPAEAPDAGDRD

SEQ ID NO: 895 - protein, 272 aa, Methylobacterium sp. B34
MDSGNRRRGRPKGFGGAKPAATIQALDRALDVLDVLAGGDGLTLSELAGRLEQSVATMHRVLATLERRGLVEISADKQEWHVGAEAYRLGSAFLRRHNVVERSRSMMWTLMQETGETSNLGVEKDGNVLFVSQVETHETIRAFFPPGSLSPLHASGIGKALLSTYAPARTERLFRGKTFARFTDKTIGSLDQLRDDVEATRRRGYAIDDEERSIGMRCVAAPILNVHGEAIAGISVSGPTHRLSDEKLRAIASGCGEAPLRSRAPSARPPRR

SEQ ID NO: 896 - protein, 278 aa, Roseivivax halodurans JCM 10272
MGEEATPRMRRTRGRPRGWRDNRGEYMIKSLDRAMEVLQYVSAHQGLTLSDLAAGLGQAPATVYRTLVTLEGRGLVEFDRDLQTWSMGAQAFVIGAQFLRRTSIVERAKPILRRLMEATGETANLGMVRERSVLFVSQAETHAPIRAFFPPGTLSPLHASGIGKALLAHMPQERFDAFLSVPLPGFTASTLTTRAALLTDCDLTRERGYAVDEEEKTEGMFCVAAPVFDASGDAAAGISVSGPVARFGRDRIANIAVHVVGAAQSLSAAIGAPSSYRA

SEQ ID NO: 897 - protein, 275 aa, Pelagicola litoralis DSM 18290
MPPPIRNKGRPKAFNTDTTANPIQSLDRALVVLETLAQSNGMTLSEIASHLDQSVATMYRVLSTLAARGFVENDPQTQAWHIGPMSFRLGSAFLRRSSVVERARPVMRDLMQATGETANLGIEKDGHVMFLSQVETHESIRAFFPPGTLSPMHASGIGKALLSCYSDDALSWFLRTHARESFTEHTLCDPETLRAEMQNARHLGYAVDDEEKNLGMRCVAAPIFNFYGEAVAGISVSGPISRLTQERVAQVGADVKSAAESLSRGLGAEPDAPQS

SEQ ID NO: 898 - protein, 272 aa, Thalassobacter stenotrophicus DSM 16310
MKSKRGRPKAFHDTTEQNTIQSLDRALHVVNYVAQSPDRSLTEIATALEQSPATVYRVLVTLAGHQMVEMDPAEQTWHIGAGAFRLGSAFLRRSSLVERARPVMRHLMERTGETANIGIEKNGRVLFLGQVETHESIRAFFPPGTQAPMHTSGIGKAILSHFGPDRVHKIFESEAETYFTAHSLGTLDALTDDLALTRTRGFAVDNEERTLGMRCIAAPIFNSEGEAIAGLSISGPVVRISQDRVPEISRAVTEAAHKLTEAIGGPAMPVES

SEQ ID NO: 899 - protein, 286 aa, Methylobacterium sp. UNC300MFChir4.1; identical to SEQ ID NO: 831

SEQ ID NO: 900 - protein, 279 aa, Paracoccus pantotrophus DSM 1403
MSVQIRKRGRPRGRAGGLGAEDSGGIRALDRALDILDLIAVSSGLTLTEIAQRLEMAPSTVHRVLVTLAARGVAESDSQTQAWHVGPTAFRHGSAFMRRSGLVERARPLLRRLMEVTGETANLGILNGDAVLFLSQAETHETIRAFFPPGTRSALHASGIGKALLAHARPADLKRMIREMRLERFTEMTLTDPQALLDDLARIRARGYALDNEERTPGMRCIAAPIFDLAGEAAAGISVSGPSLRMSDARLEAMSEAVIEAARELSLGMAPHAGAGEGR

SEQ ID NO: 901 - protein, 269 aa, Rhizobium lusitanum P1-7; identical to SEQ ID NO: 760

SEQ ID NO: 902 - protein, 256 aa, Paracoccus alkenifer DSM 11593
MAENGVQSVARALSLMRLLAQEDGGSRLSDVARAAGLPVSTAHRLLTTLEQQGFAQFEPASSLWHVGRDAFTVGLAYGRRLSFVAPALPLLRRLRDATRETANLGILDDDHLVTVSQVESREIRRALSPPGRRVPVFSSAMGKAILATWRDQEVLALADRAGLPPLTTKSLRSREAALAEIARTRARGWALDDEEFNLGMRCLAAVVWSPQGEAACAISISGAAVRLTEDRLEPLGALVAQAAEELTGVLGGVAPG

SEQ ID NO: 903 - protein, 276 aa, Paracoccus alkenifer DSM 11593
MESTSTRPRGRPSSGGPAAGSAVVDRALALLEVLAAGDGATLSELGRRLGLAPSTTHRLLAALAARRLVEADPLTQLWHVGPGAFRLGAAFLRRGGLAERARPLMAQLAADSGETAVLAVADGDAALVVAESQAAGSLRVVLPPGARLAYHATAPGKALIAHLPLARVRALLGQGALPALTPRSFTDQGELTAELATLRHGGWLAERGESVPGQSGIAAPVFGGSGDPVAALGIIGPSVRLDDAALARLGPAVAAAAAGLGAALGGPALSPQTGKR

SEQ ID NO: 904 - protein, 299 aa, Paracoccus alkenifer DSM 11593
MQQPVRRRGRPRNSPSDAQATGIQSLNRALDVLEALARHEGITLTELAAHLDESPSTMYRVLATLEQRRYVESNPDKQEWFIAAEAFRLGSAFLRRTNIVERSRPVMRDLMARTGETSNLGIERDGDVLFVSQVETHETIRAFFPPGTRSPLHASGIGKALLGAFAEERLAGFLRTASFTRFTDRTVADAGQMQADIARTRSRGYAFDDEERTVGMRCVAAAIINGHGEAVAGISVSGPTIRMPDQRVREIGGLVAMAAAEVSRLLGAPTPAPAAPAPATDAPAVTPAVTPAVTPPVQG

SEQ ID NO: 905 - protein, 275 aa, Loktanella koreensis DSM 17925
MSDSPDQNTRARGRPRGWTDNTEQNTIKSLDRAMVVLERLSELESATLSQLASDLGQAPASIYRVLVTLQGRGIVGYETDGQIWHVGPTAYLIGSRFLRRTSLVERARPVLRRLMEQTGETANLGIRREGYVLFVSQVETHATIRAFFPPGTMSPMHASGIGKALLAYMPQDQRDRLLDGTELTQFTQFTCANRSDLESDLTHIRARGYSIDAEEKNLGMRCIAVPIFDVFGEAVAGISVSGPTSRVRVELTEDLATHVKSAGAELTHALGGTLP

SEQ ID NO: 906 - protein, 286 aa, Methylobacterium sp. 190MF; identical to SEQ ID NO: 721

SEQ ID NO: 907 - protein, 277 aa, Ruegeria sp. ANG-S4
MSQQDAAIRRGRPRQKTNGEVSAASPVSALDRGIRLLIALADTRGAALAELARSTEIPVATAHRLLTTLQHRGMVVHDASQGKWRIGPQAYRIGSTFEEEANLLEVAPPVMRILSKETGETANLAIEEGGQLLYLIQVESENPIRASIKNGTDAYFHTSGVGKAIMAHLDTASLKRLLDPLTLVSQTPNSITEKQRLMAELDMSRQRGWALDDEERSAGMRCIGAPVFDSLENVVAGVSISGPITRFPDDKLESLAASVVAAANSITNRLRNTPAGS

SEQ ID NO: 908 - protein, 272 aa, Ruegeria sp. ANG-S4
MEPPKRPRGRPKSLFKESSAGTMQSLDRALGVLTAVGEVERAALSDLSRATGVPTATTHRILSTLQKHGFVAFDDERQEWMIGIEAYRTGASFLRRSSVLEVGRPILRRLMRQSGETANLAVPDGAEVVFIGQVETQNPIRAFFPPGARTPMYASGTGKAILSALDETAVTTLMTRLDPVAFTEHTRLPGDDLLEDLAKTRARGWSHDREERYYGMSCIGAAIFDNKAEPCAGVSVSGPTVRFGPDRAPELAALVTQAASEITELSGGQLPP

SEQ ID NO: 909 - protein, 272 aa, Leisingera nanhaiensis CGMCC 1.10959; identical to SEQ ID NO: 893

SEQ ID NO: 910 - protein, 275 aa, Loktanella rosea DSM 29591
MEEEVKRGRGRPKAWDDKGAQNTIKSLDRALEVLVQLGEMQGSTLSEIAGALGQSPATVYRVLTTFQGRGFADFDPQSQVWSIGPAAFLTGSMFLRRTSLVERARPIMRDLMEATGETANLGIERDGQVLFLGQVETHATIRAFFPPGTASAMHSSGIGKALLSRMDDKRQRAVLAAGKLEQFTPHTLTDPEAMIADLHTTKARGYAFDGEERNIGMRCIAAPVYNVFGEAVAGISVSGPTSRITDDRIAALAEDVMEAAARLTRAIGGNNRPAS

SEQ ID NO: 911 - protein, 281 aa, Poseidonocella pacifica DSM 29316
MSTTLDDRKGERRGRGRPRGPAAATGSIQALDRALSVLQSLAAQGRVKLTDLALEVGIPTATAYRILTTLHSRGFVDFEEATQSWKVGLEAYRTGSAYLVQTQLVDAARPAMRDLMEESGETANLAIPDGGEVVFIGQVETRNPIRAFFQPGTRTKMHASGTGKAILAAMSEAQVVQILTRQGLPQFTETTLVTKDALFADLHLTRERGWSFDRDERHVGMSCIGAPIFNNRGDVRAGISISGPSARFDDGNIPLLGRRVRTAADWITQITGGTPPEIPAP

SEQ ID NO: 912 - protein, 271 aa, Leisingera sp. ANG-S5; identical to SEQ ID NO: 690

SEQ ID NO: 913 - protein, 272 aa, Cribrihabitans marinus DSM 29340
MPDPTPRKGRPRAFAGPGSQPTIQALDRALTVLDALAAADGLTLTELSRSLDQSTATVHRILATLEARQVVEMDMQQQAWHIGAMAFRLGSAFLRRMSVIDRSRAAMRALMQDTGETSNLGIERNGEVMFVSQVETQESIRAFFPPGTLSPMHASGIGKALLSRYPEDRLERFLRRRVLQRFNAQTITDPGALKTDLAQVRARGWALDDEEKAAGMRCVAAPIVDIHGEAVAGISVSGPTQRMPPARIEEIGALVRGAAAEVSRGLGAPLSD

SEQ ID NO: 914 - protein, 279 aa, Ruegeria mobilis DSM 23403
MDSQENAPKATRRARGRPRDWHDKTAQNTIKSLDRAMEVFEFLSEAQGKPLTMIAEEMGQSPATVYRILVTLEGRGLVEFDTEEQLWHIGARAFVIGARFLRRTSLVDRARPILRKLMEETGETANLGIEKEGHVLFLSQVETHASIRAFFPPGTLSQMHASGIGKALLAQMDVGRLDRLLATTRLEVFTDHTITDHEALKQDLTAIRAQGFAVDNEEKNAGMRCIAAPVFDMNREAIAGISVSGPTSRISAQEITQLSRPVIEAAHALTLAIGGDVAS

SEQ ID NO: 915 - protein, 275 aa, Pseudopelagicola gijangensis DSM 100564
MQPPLRKKGRPKAFNSDAAANPIQSLDRALIVLETLAGHSGLTLSEIAEKLDQSAATMYRVLTTLAARGFVESEPQTQEWHIGPASFRLGSAFLRRSSVVERARPVMRTLMEATGETANLGIEKDNMVMFVSQVETHESIRAFFPPGTLSQMHASGIGKALLSLFPERRLERFLREQTLTDFTEKTLSDPDAIRAEMARSRAQGFAVDDEEKNLGMRCVAAPITNFYGEAVAGISVSGPVSRMTSDRIPEVAALVKAAAGELSQGLGADTPNPEK

SEQ ID NO: 916 - protein, 273 aa, Ruegeria atlantica CECT 4293
MDNQKRPRGRPKSLFKESSAGTMQSLDRALGVLTTVARLERAALSDLAREIDVPTATTHRILVTLQKHGFVAFDDERQEWMIGIEAYRTGASFLRRNSVLEIGRPILRRLMQDSGETANLAVPDGSEVVFVGQVETPNPIRAFFPPGARTPMYASGTGKAILAAMTETGLAKTLGAIDPVEFTANTQIPGDGLQQDLAKTRTRGWSHDREERYQGMSCIGSAIFNDRGEPCAGISVSGPTARFGVDRAHVLGELVLAAAQEITHLSGGQTPKT

SEQ ID NO: 917 - protein, 277 aa, Ruegeria atlantica CECT 4293
MNETKKPLRRGRPRLKANEEKAEVSLVVALDRGIQVLICLADRRCATLAELAKITAIPAATAHRLLTTLQQRGMVIHDAEKGKWRIGPQSYRIGSTFEEGSNLLEVAPAVMRLLSEETGETANLAVEEGGLLLFLVQVESENPIRASFKNGTAAHFHTSGVGKAIMAFMNEAALESFLTPQILVQQTPNSITDAQELKAELCKTRERGWALDDEERFLGMRCIAAPIFDSLGKVVAGVSVSGPIARFPDHKLEGLATLVVKAAATISDKLTHSSAGS

SEQ ID NO: 918 - protein, 272 aa, Thalassobacter stenotrophicus CECT 5294; identical to SEQ ID NO: 898

SEQ ID NO: 919 - protein, 281 aa, Loktanella sediminilitoris DSM 29955
MESHENENPGARRARGRPRGWDDKTAQNTIKSLDRAMEVYEFLSEAQGKALTTISTEMGQSPATVYRVLVTLEGRGLVEFDPVEQVWHIGPQAFVIGARFLRRTSLVDRARPILRKLMEQTGETANLGIEKEGAVLFLSQVETHASIRAFFPPGTLSPMYASGIGKALLAEMDDDRLARAMAFQELSAFTPFTITDADALRADLAQVRANGFSVDGEEKNLGMRCIAAPVFDVNAEAIAGISVSGPTSRVSPDDIDRLSAFVKDAAHALSLAIGGQADGRS

SEQ ID NO: 920 - protein, 269 aa, Rhizobium taibaishanense DSM 100021T
MPVEMRKRGRPKAFNGPQSQNTIQALDRALDVLEALATPEGMTLSKLADHLGQSTATMHRVLATLERREFVEISPDRQVWHIGPEAYRLGSAFLRRSNVVERSRPIMRELMLETGETSNLGIEKGGHVLFISQVETHESIRAFFPPGTLSPLHASGIGKALLSTYDGDRLTALFKTRELERFTENTVRSLDQLKEELQRTRERGYAFDDEERTWGMRCVAAPILNVHGEAVAGISVSGPKIRLQDADVHQIGERVRRAASMVSRRIGAP

SEQ ID NO: 921 - protein, 279 aa, Rhizobium taibaishanense DSM 100021T
MEKQCVKESGSVQSIHRALSILERLSASDEGLTLKEVAAQVSLPPSSAHRILTTLQRQRFVRFDQATMCWSIGVQAFLVGNAFSRSRDMVALSIPFMRRLMLASGETVNFFMLDGSEVVCMAQVQSQQMVRAISRPGGGAEMHRSAAGKMILAHMSDEEVAAIITRKGMARYTDHTITTQEALIQELARIRERGFSVDNEEFFTGLRCIAAPIYDETGSVYAAVSIAGPTSRITEARTQAMGELVEICARSITSEFGGSPTASKSRPGHSLHYPTARLS

SEQ ID NO: 922 - protein, 282 aa, Rhodobacteraceae bacterium JGI 01_L11_4000m
  MISC_FEATURE: Contamination screened
MDSQENGSGAARRARGRPRGWTDKTAQNTIKSLDRAMEVFEYLSEAQGKPLTKLADEMRQSPATVYRILVTLEGRGLVEFDHEEQVWYVGPRAFVIGARFLRRTSLVDRARPIMRKLMETTGETANIGKGQEDAVLFLSQVETHANIRAFFPPGSLSPMHASGIGKALLAYMEPERLDKLLSKGQMTRFTAHTIVDPAALRQNLEAIRESGFSVDNEERNEGMRCIAAPVFDMNGEAVAGISISGPTSRVGASEVEELSRPVIKAAHELSLAIGGDVTRPQP

SEQ ID NO: 923 - protein, 246 aa, Sulfitobacter sp. HI0054
MEVFEYLSEAQGKPLTKLADEMRQSPATVYRILVTLEGRGLVEFDHEEQVWYVGPRAFVIGARFLRRTSLVDRARPIMRKLMETTGETANIGKGQEDAVLFLSQVETHANIRAFFPPGSLSPMHASGIGKALLAYMEPERLDKLLSKGQMTRFTAHTIVDPAALRQNLEAIRESGFSVDNEERNEGMRCIAAPVFDMNGEAVAGISISGPTSRVGASEVEELSRPVIKAAHELSLAIGGDVTRPQP

SEQ ID NO: 924 - protein, 304 aa, Labrenzia aggregata CECT 4801
MLYFSYGELIFQNQKNELMTDLKSDSSATRRARGRPRAWDDKTEQNTIKSLDRAMAVFEHLSTQSGVSLSALSDQLGESTATLYRILFTLETRGLVEFDQAQQLWHIGPGAFIIGARFLRRTSLVERARPVLRSLMEQTGETANLGVAQADQVLFVSQVETHESIRAFFPPGTLSPLHASGIGKALLAFMDEDQCKRILKQTDRERFTEHTLCDAALLATDLEAIRARGFSIDGEEKNLGMRCIAAPVFNHYGEAVAGLSVSGPTSRVSPDSIAPFAEAVKAAAAALTAALGGEIAPPQTKTVG

SEQ ID NO: 925 - protein, 301 aa, Roseobacter sp. SK209-2-6
MPKPCIFHIVKVSFIENQRHLLESQDNPSKSPRRARGRPRDWEDKTAQNTIKSLDRAMMVLEFLSEGQGKPLSELAQDLQQSPATLYRVLTTLEGRGLVEFETETQAWHIGAQAFVIGARFLRRTSLVERARPILRRLMEQTGETANLGVEKGGMVLFLSQVETHESIRAFFPPGTLSQMHASGIGKALLAEMEPSRLERVLKEHPLAEFTTQTITDAGHLRQDLLLIQDRGYAIDDEEKNLGMRCIAAPIFDMHQEAVAGLSVSGPTSRISRDHISEIGAVVIEAAAEVSSAIGGQALRR

SEQ ID NO: 926 - protein, 278 aa, Rhodobacterales bacterium HTCC2083
  MISC_FEATURE: scf_1106200183017 genomic scaffold
MPKLPDSEIPRTRGRPRAFNEKTEQNTIKSLDRALGVLKELAQIESATLSELATAMKESPATLYRVLTTFALHGIVEMDETAQTWHIGSEAYQIGSAFLRRTSLIDVSRPILRKLMQETGETANLGIEKNGSVFFMSQIETNAPIRAFFPPGTLSEMHASGIGKALLAHMDETQLKRFAARGLQTFTPHTLATPESLAADMVTTRERGYALDDQEKNLGMRCIAAPIQDAYGEVIAGISVSGPTTRVSTDHIETLAKSVMRAAQDVSNALGAKTSEPS

SEQ ID NO: 927 - protein, 278 aa, Agrobacterium sp. ATCC 31749 AGT22
MQQTVRKRGRPKGAKPTQPAASIQALARSLDVLEALASHDGVTLTELSKYLDQSPATLHRILATLENRRYVESNTERQEWFVGPEAFRLGSAFLRRTNIVERSRPVMRDLMARTGETSNLGIERDGDVLFISQVETHDTIRAFFPPGTRSPLHASGIGKALLSAFDDDRLEAFLKTATFTRFTDKTIANIKELRESIQQTRRLGYSVDDEERTIGMRCVAASIVNSYGEAVAGISVSGPTIRMPDKRVREIGQLVSDAANEISLQLGSPLLNLPRHRD

SEQ ID NO: 928 - protein, 276 aa, Paracoccus sp. TRP; identical to SEQ ID NO: 675
  MISC_FEATURE (1)..(276): Paracoccus_TRP_Contig_10

SEQ ID NO: 929 - protein, 277 aa, Artificial Sequence
  synthetic peptide
  MISC_FEATURE (1)..(277): pAqui_F126
MPQPPRRKGRPKSFDSASQPATIQSLDRALDVLDALAAANGMTLTELSSALGQSAATMYRVLSTLEVRQIVEVEPQSQTWHIGAMAFRLGSAFLRRSSVIERARPVMRELMEATGETSNLGIERGGDVMFVSQVETHESIRAFFPPGTTSPMHASGIGKALLSCFGEDQLTRFLRGQALERFTEKTLTSAEALRADLAQIRSRGWSFDDEEKAPGMRCVAAPVFGMQGEVLAGISISGPTARMPDGGINGIGALVKDAAEKLSYGLGAPAAVETPPG

SEQ ID NO: 930 - protein, 279 aa, Ruegeria mobilis F1926; identical to SEQ ID NO: 884

SEQ ID NO: 931 - protein, 283 aa, Oceanicola sp. HL-35
MESQDNGPGGVRKARGRPRDWHDKTAQNTIKSLDRAMEVFEFLSERQGMALSTISDEMRQSPSTVYRILVTLETRGLVEFDAEEQLWHIGPRAFTIGARFLRRTSLVDRARPAMRRLMEMTGETANLGVEKESAVLFLSQVETHATIRAFFPPGTLSPMHASGIGKALLAQMEEDRLSRWLAGRGRLEAFTERTITDPDRLRQDLKQIRTRGYAIDDEEKNAGMRCIAAPVFDITGEAVAGISVSGPTSRVTREQTESLSRPVMEAARTLTQSIGGVVIPPRS

SEQ ID NO: 932 - protein, 170 aa, Ensifer meliloti Rm41
MQVVKRRRGRPKAFNSPESPSVIQSLDRALDVLEALASPEGLTLSQLAAHLGQSVATMHRVLSTLERREFVEISPDRQVWHIGPEAYRLGSAFLRRTNVVERSRPIMRELMLETGETSNLGIEKDGHVLFISQVETHESIRAFFPPGTLSPLHASGIGKALLSTYDDSRL

SEQ ID NO: 933 - protein, 273 aa, Ensifer meliloti Rm41
MEAKGKGKRGRKAGENAAPASVQVLDRSLSLLAIIAEGDGSTLTALSERSGMAPSTVHRLLTSLAQHEMVANDAEAGTWTVGVKAFEIGNAFLRFRKLGTISRPFLKRLMDESGETANIGIEEDGDVVFISQVESHAPMRAFFRPGRRGPIHASGIGKAILSTWSDTEIAKTLSGRTLACFTGRTLATLPDLIRNVQEIRFRGWSVDDEEHTLGMRCIAAPLFNEYGEAIGGISISGPTVRIDDERLGVLGPAVRRMADELTRAIGGHRPEEG

SEQ ID NO: 934 - protein, 275 aa, Roseovarius sp. MCTG156(2b)
MTQTKRPRGRPKSQFADSSAGTMQALDRALAVLTAVARQEGVNLTDLSLSLGIPTATTHRILTTLQKRDFVRFDEERQDWTIGIEAYRTGVAYLKRTNLADAGRPVMRRLMEQTGETANLAVPDGAEVVFIGQVETQNPIRAFFPPGSRTPMHASGTGKAILAALPEDRLMALLKGAGLKGFTEDTLITPRALFDDLAETRRRGWSFDRNERYDGMSCIGAAIFNDRGEPCAGVSISGPSSRFRDAQIAEFGAAVAQAAAQITHLIAGHGLMPGQ

SEQ ID NO: 935 - protein, 269 aa, Rhizobium rhizogenes OK036
MPGEPRRRGRPKAFNGPQTQNTIQALDRALDVLDALATPEGKTLSELASQLDQSAATMHRVLATLERREFVEISPDRQVWHIGPEAYRLGAAFLRRSNVVERSRPIMRELMLETGETSNLGIEKDGNVLFISQVETHESIRAFFPPGTLSPLHASGIGKALLSTYDEDRLSTLFKKKEFERFTDNTVRSFEQLREELQKTRERGYSFDDEERTKGMRCVAAPILNVHGEAVAGISVSGPIHRLPDADINQIGERVRSAARMVSRRLGAP

SEQ ID NO: 936 - protein, 269 aa, Rhizobium leguminosarum YR374; identical to SEQ ID NO: 828

SEQ ID NO: 937 - protein, 286 aa, Methylobacterium sp. YR668; identical to SEQ ID NO: 721

SEQ ID NO: 938 - protein, 278 aa, Sinorhizobium americanum CCGM7
LAVAVVSEQAKGKRGRKAGANSTPSSVQVLDRSLALFSLVADRDGSTLTDLADETGLAPSTIHRLLTSLSSHGMVAHDPDTGEWTIGVRAFEIGNAFLRFRKLGTISRPYLKRLMDESGETANIGIEDDGDVVFISQVESHAPMRAFFRPGRRGPSHASGIGKAILSTWSDTEIAKTLGGRTLTHFTDRTLDTLPALIRNIQEIRNRGWSIDDEEHTLGMRCIAAPLFNEYGEAIGGISISGPSVRIDDNRLEPLGSLVRRTADELTRAIGGHRPGEG

SEQ ID NO: 939 - protein, 269 aa, Sinorhizobium americanum CCGM7
MQVVKRRRGRPKAFNAPESSNVIQSLDRALDVLEALASPEGLTLSELAAHLGQSAATMHRVLSTLERREFVEISPDQQVWHIGPEAYRLGSAFLRRTNVVERSRPIMRELMLETGETSNLGIEKDGNVLFISQVETHESIRAFFPPGTLSPLHASGIGKALLSTYDDSRLASLFKKTTLERFTANTVRSVAQLEEELRVTRDRGYAFDDEERTKGMRCVAAPILNVHGEAVAGISVSGPTHRMPDRQVQEIGERVRNAAKMVSRRLGAP

SEQ ID NO: 940 - protein, 281 aa, Palleronia marisminoris DSM 26347
MDFQDNAGRGTRKARGRPRDWDDKTAQNTIKALDRAMEVFEFLSERQGMALSAISAEMGQSPSTVYRVLVTLENRGLVEFDAGEQLWHIGPRAFMIGARFLRRTSLVDRARPVMRALMEATGETANLGVEKEGMVLFLSQVETHANIRAFFPPGTLSAMHASGIGKALLAQMDDARLARRLGDGLEAFTKKSIIDYGALLADLRETRTRGYSYDDEERNIGMRCIAAPVFDINGEAIAGISVSGPTSRLTGDGLERLSRPVMEAARTLTEAIGGSITPQRT

SEQ ID NO: 941 - protein, 279 aa, Paracoccus aminovorans DSM 8537
MSLEVRKRGRPRGRAGGPGAEDSGGIRALDRALDILDLIAGSSGLTLSEIGQRLEMAPSTVHRVLVTLAARGVAESDPTTQAWHVGPTAFRHGSAFMRRSGLVERARPLLRRLMEQTGETANLGILNGDAVLFLSQAETYETIRAFFPPGTRSALHASGIGKALLAHVRPGELRLMLAEMRLQRFTDKTLCEPRALQEDLARIRERGYSLDNEERTPGMRCIAAPIFDLAGEAAAGISVSGPTLRMSDARLESMSAAVVAAAKELSLGMAPAGGPMRES

SEQ ID NO: 942 - protein, 280 aa, Yangia pacifica CGMCC 1.3455; identical to SEQ ID NO: 878

SEQ ID NO: 943 - protein, 277 aa, Roseovarius indicus DSM 26383
MPSDTAPDPQNRRARGRPRGWDDKTEQNTIKSLDRAMLVFEHLSRSQGKMLTELADDLNQSPATVYRVLVTLETRGLVEFDPAEQLWHIGPQAFVIGAGFLRRTSLVERARPILRRLMEVTGETANLGRELDGQVLFLSQVETNATIRAFFPPGTLAEMHSSGIGKVLLAQMSEERIARILADHPMQAFTPNTITDPATLSRELATIRAQGFAIDAEERNEGMRCIAAPVFDHSQSAVAGLSVSGPTSRVSEEKTDEFSHAVIQAARDLSAALGGLP

SEQ ID NO: 944 - protein, 274 aa, Jannaschia rubra DSM 16279; identical to SEQ ID NO: 734

SEQ ID NO: 945 - protein, 269 aa, Rhizobium etli bv. phaseoli IE4803
MQNPNRRRGRPKSFNEPQSSSVIQSLDRALDVLEALASPEGMTLSELSAHLDQSPATMHRVLATLERREFVEISPDRQVWFIGPEAYRTGAAFLRRSNVVERSRPIMRELMLETGETSNLGIEKDGNILFISQVETHESIRAFFPPGTLSPLHASGIGKALLSTYDDDRLSALFKTSTLKRFTENTARSVAQLKEELIVSRERGYAIDDEERTKGMRCVAAPILNVHGEAVAGISVSGPTHRMPDRLIRQIGERVTGAAKTVSRRLGGG

SEQ ID NO: 946 - protein, 281 aa, Roseivivax sediminis DSM 26472
MESPENGGRGPRRARGRPRGWDDKTEQNTIKSLDRAMEVFEFLSEAQGKALTAIAGEMGQSPATVYRILVTLEGRGLVEFDAEEQLWHIGPRAFVIGARFLRRTSLVERARPVLRRLMEATGETANLGVGRDASVLFLSQVETEASIRAFFPPGTLSPMHASGIGKALLAHMDEDRLARVLKVAVLTAFTDHTLTDAEALRQDLGVIRTRGYSIDNEEKNAGMRCIAAPIFDMHGEVTAGLSVSGPTSRIGLDQVAPLSGHVLAAAHDLTAAIGGVTPPRN

SEQ ID NO: 947 - protein, 278 aa, Agrobacterium sp. KFB 330
MQQTVRKRGRPKGAKPTQPAASIQALARALDVLEALASHDGVTLTELSNYLDQSPATLHRILATLENRRYVESNTERQEWFVGPEAFRLGSAFLRRTNIVERSRPVMRDLMARTGETSNLGIERDGDVLFISQVETHDTIRAFFPPGTRSPLHASGIGKALLGAFDDDRLEAFLKTATFIRFTDKTIANIKELRESIQQTRRLGYSFDDEERTIGMRCVAASIVNSYGEAVAGISVSGPTIRMPDKRVREIGQLVSDAANEISRQLGSPLLSLPRHRD

SEQ ID NO: 948 - protein, 271 aa, Leisingera sp. ANG-DT; identical to SEQ ID NO: 690

SEQ ID NO: 949 - protein, 282 aa, Methylobacterium sp. ME121; identical to SEQ ID NO: 704

SEQ ID NO: 950 - protein, 281 aa, Litoreibacter meonggei DSM 29466
MESQNNAGISHRKARGRPRDWDDKSAQNTIKSLDRAMEVFEFLSEAQGKTLTMLANDLSQSPATVYRILVTLEGRGLVEFDQIDQVWHVGPRAFIIGSRFLRRTTLVDRARPILRTLMEQTGETANLGIEQNGHVLFVSQVETHASIRAFFPPGTLSRLHASGIGKALLSQMEDARVDKFLTDMPLESFTEFTLTQPDALKADLELTRQRGYSIDGEERNVGMRCIAAPVFDIHGEAIAGISVSGPTSRVGTEEIANLSTSVLSAARELSAAIGGVAPAAR

SEQ ID NO: 951 - protein, 281 aa, Litoreibacter halocynthiae DSM 29467
MDSQDNAGISQRKARGRPRDWDDKSAQNTIKSLDRAMEVFEFLSEAQGKTLTMLANDLSQSPATVYRILVTLEGRGLVEFDQDDQVWHIGPRAFVIGARFLRRTSLVERARPVLRSLMEDTGETANLGIEQNGHVLFVSQVETTASIRAFFPPGTLSRMHASGIGKALLAEMEEHRISKLLSKAPLEGFTEFTLTDHTALLEDLRLSKARGYAIDGEERNLGMRCIAAPVFDINGEAIAGISVSGPTTRVGADQVAALSEAVVAAASRLTNAIGGAAVPAR

SEQ ID NO: 952 - protein, 275 aa, Roseivivax lentus DSM 29430
MQAPKRQRGRPKSQFTESSAGTLQSLDRALSVLVALSRAGRMTLSDLALAVGVPTATTHRILMTLQKHDFVAFDEDRQDWLIGIEAFRTGAAFLKRSNLVEIGRPVMQLLMEETGETANLAVPQKAEVVFVGQIETLNPIRAFFPPGTRTAMHASGTGKAILADLPEDKVKRLLSAAGLERFTANTRTTPADLFADLARTRARGWSFDREERYESMSCIGATIFDEMGNPCAGVSISGPSIRFDEDRIAAFGTAVKNAADEITRRLGGLPPERAR

SEQ ID NO: 953 - protein, 275 aa, Rhodovulum sulfidophilum DSM 2351
MTQPRPRGRPRAFHDKTDQNTVRALDRAMGLLTALSETKGLTLSELAALSNQSPATVYRVLITLQGHDIVELEEEAQRWHVGPGAFRIGSGFLRRTNVAERSRGAMQALMRATGETANLGVEDRDEVLFLTQVETHETIRAFFSPGTRGPMHCSGIGKALLAFLPAARVAAILETQGLPGFTPRSITSETGLHADLDRTRARGYAIDDQERAEGMRCIAAPIFNAHGEPIAGLSVSGPAFRIPLDAADGIGAEVRAAADRVTAATGGISPTEKSA

SEQ ID NO: 954 - protein, 285 aa, Roseobacter denitrificans DSM 7001; identical to SEQ ID NO: 670

SEQ ID NO: 955 - protein, 277 aa, Leisingera sp. ANG-Vp
MPQPPRRKGRPKSFDSASQPATIQSLDRALDVLDALAGASGMTLTELSSALDQSAATMYRVLSTLEARQIVEMEPQSQTWHIGAMAFRLGSAFLRRSSVIERARPVMRELMEATGETSNLGIERGGDVMFVSQVETHESIRAFFPPGTTSPMHASGIGKALLSCFEDDQLTRFLRGRALERFTEKTLTSAEALCADLAQIRQRGWSFDDEEKAPGMRCVAAPVFGMQGEVLAGISISGPTARMPDGGISGIGALVKDAAQKLSYGLGAPAADETPPG

SEQ ID NO: 956 - protein, 275 aa, Marivita hallyeonensis DSM 29431
MNAEAPPERRSRGRPRAWGDTTEQNKIKSLDRALMILERLGERGGATLTDLAEDLKQSPATVYRVLFTFEARGIVDFDPSAQTWHIGAGAFQIGSRFLRRTSLVERARPFLRELMQRTEETANLGMMRDGQVLFLSQVETHHNIRAFFPPGAMSDMHASGIGKALLAQLPDKDVASIIRARKLSRFTDETLVTPEALAADLEQTRRRGYAFDKEEKNPGMRCIAAPVFDMHSEPIAGVSISGPSARIPDERVEELARAVQHAATQLTEALGGTPP

SEQ ID NO: 957 - protein, 282 aa, Labrenzia alba CECT 7551
MPDPKMEATATRRARGRPRSWDDKSGQNTIKSLDRAMSVFEHLSTQRGVSLSALSDQLGESTATLYRILFTLETRGLVEFDQAEQLWHIGSGAFIIGARFLRRTSLVERARPILRKLMEDTGETANLGVSQSHQVLFVSQVETHSNIRAFFPPGTLSPMHASGIGKALLAFMDPDLCERIVSRGQMERFTEHTLCDAEGLMADLEQIRKRGYSIDGEEKNVGMRCIAAPVFDHFGEAVAGLSVSGPTSRVSQDKIDTLSVGVMAAAEALTSAIGGDVTRQRS

SEQ ID NO: 958 - protein, 275 aa, Labrenzia alba CECT 7551
MTEKQATIRRGRPKRTERDPDTAGPTILALDRGLNALIFLADNQNATLTEISRGTNTPVATAHRILTTLQQRGMVLFNENEGNWTVGAQAFRVGNAYQAGSNLMAAATPVMEELSQLTGETANLAIEDSGELLYLIQVESNNPIRASLKNGAASYFHTSGVGKALLAYKDKTQLERFLKGRSLVRQTSKSITDHDLLKSELIRIKEMGWALDDEERYMGMRCIAAPVYDPLGQAMAGVSISGPSSRFPDDQLQNLASKVQNAAGRISKSLESSDF

SEQ ID NO: 959 - protein, 269 aa, Thalassobius abyssi DSM 100673
MSSPPRQRGRPKSFHSKQAQNTIQSLDRAIDVLEHLAQHGSQTLTEISTSMEQSPATIYRVLTTFEARGLVETEGLSQVWAIGPATFRIGSSFLRRTSLVERARPAMRSLMETTGETANLGIRTGANVIFISQVETHHSIRAFFPPGTISAIHASGIGKALLSAMSEESVRELLKRSSLEAFTRNTMSDLDALCADLQISRDRGFALDDEERTEGMRCIAAPIRDLNGDTVAGVSISGPSHRMKPSVVKEFGTLVKTVGENLSSSLGAP

SEQ ID NO: 960 - protein, 277 aa, Roseovarius indicus; identical to SEQ ID NO: 943
  MISC_FEATURE: B108 cultivar
  MISC_FEATURE (1)..(277): B108 cultivar

SEQ ID NO: 961 - protein, 276 aa, Litoreibacter ponti DSM 100977
MLESAPKKRARGRPKAFNDKSEQNTVQSLERALSVLKHLAEQRGIALSDLAKETDQSPATLYRILTTFQLHQMTEFDENEQLWHIGAGAYRVGANYLRRTSVVERSRPVMRQLMQDTGETANLGVEQADMVLFVSQVETHESIRAFFPPGTQSKMHASGIGKALLAYYPPERLDQWFLQQRLTRYTDATITDPDVLRQELADIRVTGLSFDNEEKNIGMRCIASPVFDGFGEPVAGLSVSGPSSRMTDAMIDAIGAHVKAAAARVTEAVGGQPPER

SEQ ID NO: 962 - protein, 280 aa, Yangia sp. CCB-MM3
MDSPKDAETSPRRARGRPRGWEDNSAQNTIKSLDRAMEVLDYLSAHPGLTLSELAGDLRQSPATVYRILVTLEGRRLVEFDPAEQLWHIGPQAFVIGARFLRRTSLVERARPILRALMEETGETANLGIVREASVLFVSQVETHESIRAFFPPGTLSPLHASGIGKALLAEMAGERLEKLLARKMERFTAHTLAEPEALRADLAAIRARGYSIDAEEKNLGMRCIAAAVFDASGEAAAGISVSGPTIRMREDMTDETSRAVMRAARELTSAIGGVTPPER

SEQ ID NO: 963 - protein, 275 aa, Granulosicoccus antarcticus IMCC3135
MKRPVIAAEPPKRGRGRPRLQHSDTEVSVVQALDRGLTLLQILAREGAVNLTDLSLQAGMPAPTAHRLLTTLMRQQFAAYNESTQMWTVGVQAYSVGSSYLARTSLVELAKPVMRTLMEETGETANLAVTEGGYVVFLSQVESNHPIRAYHRPGSRSHLHVSGIGKALLACRSKSEVEKILQKRGLPAFTPHTLSSPSALFENLELTRQRGWSFDNEEHFEGMRCVAAAITDAQGESLAGISVSGPSTRFPENHVAEIGPKVQRAAEQISRELGA

SEQ ID NO: 964 - protein, 282 aa, Tateyamaria omphalii DOK1-4
MSDLQNAQESPRRARGRPRGWDDKTEQNTIKSLDRAMEIFEYLSTDQGKTLSQLASELNQSPATVYRVLITLEARGLVEFDAEEQRWYIGARAFVIGARFLRRTSLVDRARPILRALMERTGETANLGIEKGGMVLFLNQVETHESIRAFFPPGTLSDMHASGIGKALLAFMDEDRFGRWLRGRSFETFTAHTLVAPDALVQELHRTRVRGYAIDAEEKNLGMRCIAAPVFDMYGEAVAGISVSGPATRMGSDVTDRISRSVVDAASELTRAVGGADRHAVG

SEQ ID NO: 965 - protein, 43 aa, Artificial Sequence
  synthetic peptide (Conserved amino acid sequence of the eta-hydroxyaspartate regulatory protein)
  misc_feature (3)..(25): Xaa can be any naturally occurring amino acid
  misc_feature (27)..(31): Xaa can be any naturally occurring amino acid
  misc_feature (33)..(42): Xaa can be any naturally occurring amino acid
ETXXXXXXXXXXXXXXXXXXXXXXXRXXXXXGXXXXXXXXXXG

The invention claimed is:

1. A method for the production of autotrophic microorganisms with altered photorespiration comprising introducing into an autotrophic microorganism expressing (i) phosphoglycolate phosphatase activity one or more nucleic acids encoding polypeptides having the enzymatic activities of:
  (ii) glyoxylate reductase,
  (iii) erythro-β-hydroxyaspartate aldolase belonging to the EC class 4.1.3.14,
  (iv) erythro-β-hydroxyaspartate dehydratase belonging to the EC class 4.3.1.20,
  (v) iminosuccinate reductase and
  (vi) aspartate-glyoxylate transaminase, wherein the introduction of the one or more nucleic acids results in an altered autotrophic microorgansim having de novo expression of polypeptides having the enzymatic activities of
  (ii) glyoxylate reductase,
  (iii) erythro-β-hydroxyaspartate aldolase belonging to the EC class 4.1.3.14,
  (iv) erythro-β-hydroxyaspartate dehydratase belonging to the EC class 4.3.1.20,
  (v) iminosuccinate reductase, and
  (vi) aspartate-glyoxylate transaminase.

2. The method of claim 1, wherein said polypeptides having the enzymatic activities of (iii) erythro-β-hydroxyaspartate aldolase, (iv) erythro-β-hydroxyaspartate dehydratase, (v) iminosuccinate reductase and (vi) aspartate-glyoxylate transaminase are from a proteobacterium.

3. The method of claim 2, wherein polypeptide having the enzymatic activity of (v) iminosuccinate reductase comprises an amino acid sequence having at least 80% sequence identity to a sequence selected from SEQ ID NOs: 2 and 66-363.

4. The method of claim 1, wherein the polypeptide having the enzymatic activity of (v) iminosuccinate reductase comprises an amino acid sequence having at least 80% sequence identity to a sequence selected from SEQ ID NOs: 2 and 66-363.

5. The method of claim 1, wherein the polypeptide having the enzymatic activity of (vi) aspartate-glyoxylate transaminase comprises an amino acid sequence having at least 80% sequence identity to a sequence selected from SEQ ID NOs: 8, and 364-662.

6. The method of claim 1, wherein the altered autotrophic microorganism has a nucleic acid with at least 80% sequence identity to the nucleotide sequence of SEQ ID NO: 62 encoding the polypeptide having phosphoglycolate phosphatase activity, the altered autotrophic microorganism has a nucleic acid with at least 80% sequence identity to the nucleotide sequence of SEQ ID NO: 64 encoding the polypeptide having glyoxylate reductase activity, the altered autotrophic microorganism has a nucleic acid with at least 80% sequence identity to the nucleotide sequence of SEQ ID NO: 3 or 44 encoding the polypeptide having erythro-β-hydroxyaspartate aldolase activity, the altered autotrophic microorganism has a nucleic acid with at least 80% sequence identity to the nucleotide sequence of SEQ ID NO: 5 or 45 encoding the polypeptide having erythro-β-hydroxyaspartate dehydratase activity, the altered autotrophic microorganism has a nucleic acid with at least 80% sequence identity to the nucleotide sequence of SEQ ID NO: 1 or 43 encoding the polypeptide having iminosuccinate reductase activity, or the altered autotrophic microorganism has a nucleic acid with at least 80% sequence identity to the nucleotide sequence of SEQ ID NO: 7 or 46 encoding the polypeptide having aspartate-glyoxylate transaminase activity.

7. The method of claim 1, wherein the autotrophic microorganism is selected from microalgae, eukaryotic microorganisms, prokaryotic microorganisms, bacteria, cyanobacteria, proteobacteria, purple bacteria, green sulfur bacteria, halophiles and methanogens.

8. The method of claim 1, wherein the autotrophic microorganism is a cyanobacterium.

9. An autotrophic microorganism expressing (i) phosphoglycolate phosphatase activity and comprising one or more heterologous nucleic acids encoding polypeptides having the enzymatic activities of (ii) glyoxylate reductase, (iii) erythro-β-hydroxyaspartate aldolase belonging to the EC class 4.1.3.14, (iv) erythro-β-hydroxyaspartate dehydratase belonging to the EC class 4.3.1.20, (v) iminosuccinate reductase and (vi) aspartate-glyoxylate transaminase.

10. The autotrophic microorganism according to claim 9, wherein said polypeptides having the enzymatic activities of (iii) erythro-β-hydroxyaspartate aldolase, (iv) erythro-β-hydroxyaspartate dehydratase, (v) iminosuccinate reductase and (vi) aspartate-glyoxylate transaminase are from a proteobacterium.

11. The autotrophic microorganism according to claim 10, wherein the autotrophic microorganism has a nucleic acid with at least 80% sequence identity to the nucleotide sequence of SEQ ID NO: 62 encoding the polypeptide having phosphoglycolate phosphatase activity, the autotrophic microorganism has a nucleic acid with at least 80% sequence identity to the nucleotide sequence of SEQ ID NO: 64 encoding the polypeptide having glyoxylate reductase activity, the autotrophic microorganism has a nucleic acid with at least 80% sequence identity to the nucleotide sequence of SEQ ID NO: 3 or 44 encoding the polypeptide having erythro-β-hydroxyaspartate aldolase activity, the autotrophic microorganism has a nucleic acid with at least 80% sequence identity to the nucleotide sequence of SEQ ID NO: 5 or 45 encoding the polypeptide having erythro-β-hydroxyaspartate dehydratase activity, the autotrophic microorganism has a nucleic acid with at least 80% sequence identity to the nucleotide sequence of SEQ ID NO: 1 or 43 encoding the polypeptide having iminosuccinate reductase activity, or the autotrophic microorganism has a nucleic acid with at least 80% sequence identity to the nucleotide sequence of SEQ ID NO: 7 or 46 encoding the polypeptide having aspartate-glyoxylate transaminase activity.

12. The autotrophic microorganism according to claim 10, wherein the one or more heterologous nucleic acids encode a polypeptide having the enzymatic activity of (v) iminosuccinate reductase comprising an amino acid sequence having at least 80% sequence identity to a sequence selected from SEQ ID NOs: 2 and 66-363.

13. The autotrophic microorganism according to claim 9, wherein the autotrophic microorganism has a nucleic acid with at least 80% sequence identity to the nucleotide sequence of SEQ ID NO: 62 encoding the polypeptide having phosphoglycolate phosphatase activity, the autotrophic microorganism has a nucleic acid with at least 80% sequence identity to the nucleotide sequence of SEQ ID NO: 64 encoding the polypeptide having glyoxylate reductase activity, the autotrophic microorganism has a nucleic acid with at least 80% sequence identity to the nucleotide sequence of SEQ ID NO: 3 or 44 encoding the polypeptide having erythro-β-hydroxyaspartate aldolase activity, the autotrophic microorganism has a nucleic acid with at least 80% sequence identity to the nucleotide sequence of SEQ ID NO: 5 or 45 encoding the polypeptide having erythro-β-hydroxyaspartate dehydratase activity, the autotrophic microorganism has a nucleic acid with at least 80% sequence identity to the nucleotide sequence of SEQ ID NO: 1 or 43 encoding the polypeptide having iminosuccinate reductase activity, or the autotrophic microorganism has a nucleic acid with at least 80% sequence identity to the nucleotide sequence of SEQ ID NO: 7 or 46 encoding the polypeptide having aspartate-glyoxylate transaminase activity.

14. The autotrophic microorganism according to claim 9, wherein the one or more heterologous nucleic acids encode a polypeptide having the enzymatic activity of (v) iminosuccinate reductase comprising an amino acid sequence having at least 80% sequence identity to a sequence selected from SEQ ID NOs: 2 and 66-363.

15. The autotrophic microorganism according to claim 9, wherein the autotrophic microorganism is selected from microalgae, eukaryotic microorganisms, prokaryotic microorganisms, bacteria, cyanobacteria, proteobacteria, purple bacteria, green sulfur bacteria, halophiles or methanogens.

16. The autotrophic microorganism according to claim 9, wherein the autotrophic microorganism is a cyanobacterium.

* * * * *